US009458211B1

(12) United States Patent
Bakker et al.

(10) Patent No.: US 9,458,211 B1
(45) Date of Patent: Oct. 4, 2016

(54) RECOMBINANT PROTEINS THAT SIMULTANEOUSLY BIND HGF, VEGF-A AND SERUM ALBUMIN, COMPRISING ANKYRIN REPEAT DOMAINS

(71) Applicant: Molecular Partners AG, Schlieren (CH)

(72) Inventors: Talitha Bakker, Birmensdorf (CH); Michael T. Stumpp, Geroldswil (CH); Hans Kaspar Binz, Birmensdorf (CH); Douglas Phillips, Baden (CH); Ignacio Dolado, Rheinfelden (CH); Patrik Forrer, Dietikon (CH); Frieder W. Merz, Mellingen (CH); Ivo Sonderegger, Urdorf (CH); Daniel Steiner, Zürich (CH); Maya Gulotti-Georgieva, Wettswil a.A. (CH); Johan Abram Saliba, Lausanne (CH)

(73) Assignee: Molecular Partners AG, Schlieren (CH)

( * ) Notice: Subject to any disclaimer, the term of this patent is extended or adjusted under 35 U.S.C. 154(b) by 0 days.

(21) Appl. No.: 15/089,014

(22) Filed: Apr. 1, 2016

(30) Foreign Application Priority Data

Apr. 2, 2015 (EP) .................................... 15162502
Apr. 2, 2015 (EP) .................................... 15162511

(51) Int. Cl.
*C07K 14/47* (2006.01)
*A61K 38/00* (2006.01)
*C12N 15/62* (2006.01)

(52) U.S. Cl.
CPC .......... *C07K 14/4703* (2013.01); *A61K 38/00* (2013.01); *C12N 15/62* (2013.01)

(58) Field of Classification Search
CPC .................................................... C07K 47/03
See application file for complete search history.

(56) References Cited

U.S. PATENT DOCUMENTS

| | | | |
|---|---|---|---|
| 7,417,130 | B2 | 8/2008 | Stumpp et al. |
| 8,110,653 | B2 | 2/2012 | Stumpp et al. |
| 8,710,187 | B2 | 4/2014 | Binz et al. |
| 8,722,618 | B2 | 5/2014 | Jacobs et al. |
| 8,846,577 | B2 | 9/2014 | Steiner et al. |
| 8,901,076 | B2 | 12/2014 | Binz et al. |
| 9,006,389 | B2 | 4/2015 | Stumpp et al. |
| 9,284,361 | B2 | 3/2016 | Steiner et al. |
| 2008/0206201 | A1 | 8/2008 | Beier et al. |
| 2011/0224100 | A1 | 9/2011 | Parmeggiani et al. |
| 2013/0236467 | A1 | 9/2013 | Griggs et al. |
| 2013/0296221 | A1 | 11/2013 | Binz |
| 2014/0005125 | A1 | 1/2014 | Baumann |
| 2014/0206599 | A1 | 7/2014 | Baumann et al. |
| 2014/0221295 | A1 | 8/2014 | Binz et al. |
| 2015/0057186 | A1 | 2/2015 | Steiner et al. |
| 2015/0299265 | A1 | 10/2015 | Fiedler et al. |

FOREIGN PATENT DOCUMENTS

| | | | |
|---|---|---|---|
| WO | WO 91/01743 | | 2/1991 |
| WO | WO 2006/122787 | A1 | 11/2006 |
| WO | WO 2007/103515 | A2 | 9/2007 |
| WO | WO 2008/096158 | A2 | 8/2008 |
| WO | WO 2008/155134 | A1 | 12/2008 |
| WO | WO 2011/095545 | A1 | 8/2011 |
| WO | WO 2014/191574 | A1 | 12/2014 |

OTHER PUBLICATIONS

Binz, "Designing Repeat Proteins: Well-expressed, Soluble and Stable Proteins from Combinatorial Libraries of Consensus Ankyrin Repeat Proteins" J Mol Biol (2003) 332, 489-503.
Forrer et al., "A novel strategy to design binding molecules harnessing the modular nature of repeat proteins," FEBS Letters (2003) 539, p. 2-6.
Stumpp et al., "Designing Repeat Proteins: Modular Leucine-rich Repeat Protein Libraries Based on the Mammalian Ribonuclease Inhibitor Family", J Mol Biol (2003) 332, 471-487.
Kohl et al., "Designed to be stable: Crystal structure of a consensus ankyrin repeat protein", PNAS (2003) 100(4), p. 1700-1705.
Binz et al., "High-affinity binders selected from designed ankyrin repeat protein libraries", Nature Biotechnology (2004) 22(5), p. 575-582.
Amstutz et al., "Intracellular Kinase Inhibitors Selected from Combinatorial Libraries of Designed Ankyrin Repeat Proteins", JBC (2005) vol. 280 No. 26, 24715-24722.
He and Taussig, "Ribosome display: cell-free protein display technology," Brief Funct Genomic Proteomic (2002) 1(2), p. 204-12.
Hanes et al., "In vitro selection and evolution of functional proteins by using ribosome display," Proc Natl Acad Sci USA (1997) 94(10), p. 4937-42.

(Continued)

*Primary Examiner* — Lorraine Spector
(74) *Attorney, Agent, or Firm* — Finnegan, Henderson, Farabow, Garrett & Dunner

(57) ABSTRACT

New designed ankyrin repeat domains with binding specificity for serum albumin, recombinant binding proteins comprising at least two designed ankyrin repeat domains with binding specificity for serum albumin, as well as recombinant binding proteins comprising at least one designed ankyrin repeat domain with binding specificity for hepatocyte growth factor (HGF), at least one designed ankyrin repeat domain with binding specificity for vascular endothelial growth factor (VEGF-A), and at least two designed ankyrin repeat domain with binding specificity for serum albumin are described, as well as nucleic acids encoding such designed ankyrin repeat domains and recombinant binding proteins, pharmaceutical compositions comprising such designed ankyrin repeat domains, recombinant binding proteins or nucleic acids and the use of such designed ankyrin repeat domains, recombinant binding proteins, nucleic acids or pharmaceutical compositions in the treatment of diseases.

27 Claims, 14 Drawing Sheets

(56) References Cited

OTHER PUBLICATIONS

Stumpp and Amstutz, "DARPins: A true alternative to antibodies," Curr Opin Drug Discov Devel. (2007) 10(2), p. 153-9.
Interlandi et al., "Characterization and Further Stabilization of Designed Ankyrin Repeat Proteins by Combining Molecular Dynamics Simulations and Experiments," J Mol Biol (2008) 375(3), p. 837-54.
Zahnd et al., "A designed ankyrin repeat protein evolved to picomolar affinity to Her2," J Mol Biol (2007) 369(4), p. 1015-28.
Forrer et al., "Consensus Design of Repeat Proteins," ChemBioChem (2004) 5, p. 183-189.
Binz et al., "Designed Repeat Proteins—Molecules with Antibody-like Binding Properties," BIOforum Europe Apr. 2005, pp. 34-36, Git Verlag GmbH & Co. KG, Darmstadt.
Binz and Pluckthun, "Engineered proteins as specific binding reagents," Current Opinion in Biotechnology (2005) 16, p. 459-469.
Binz et al., "Engineering novel binding proteins from nonimmunoglobulin domains," Nature Biotechnology (2005) 23(10), p. 1257-1268.
Amstutz et al., "Rapid selection of specific MAP kinase-binders from designed ankyrin repeat protein libraries," Protein Engineering, Design & Selection (2006) 19(5), p. 219-29.
Binz et al., "Crystal Structure of a Consensus-Designed Ankyrin Repeat Protein: Implications for Stability," Proteins: Structure, Function, and Bioinformatics 65:280-84 (2006).
Kawe et al., "Isolation of Intracellular Proteinase Inhibitors Derived from Designed Ankyrin Repeat Proteins by Genetic Screening," J Biol Chem (2006) 281(52), p. 40252-63.
Zahnd et al., "Selection and Characterization of Her2 Binding-designed Ankyrin Repeat Proteins," J Biol Chem (2006) 281(46), p. 35167-35175.
Boersma and Pluckthun., "DARPins and other repeat protein scaffolds: advances in engineering and applications," Curr Opin Biotechnol (2011) 22(6), p. 849-57.
Sennhauser and Grutter., "Chaperone-Assisted Crystallography with DARPins", Structure (2008) 16, p. 1443-1453.
Steiner et al., "Efficient Selection of DARPins with Sub-nanomolar Affinities using SRP Phage Display", J Mol Biol 2008, 382(5), p. 1211-1227 (incl. Supplement).
Stumpp et al., "DARPins: A new generation of protein therapeutics", Drug Discovery Today (2008) 13(15-16), p. 695-701.
Veesler et al., "Crystal Structure and Function of a DARPin Neutralizing Inhibitor of Lactococcal Phage TP901-1", J Biol Chem (2009) 284(44), p. 30718-30726.
Eggel et al., "DARPins as Bispecific Receptor Antagonists Analyzed for Immunoglobulin E Receptor Blockage", J Mol Biol (2009) 393, p. 598-607.
Kramer et al., "Structural Determinants for Improved Stability of Designed Ankyrin Repeat Proteins with a Redesigned C-Capping Module", J Mol Biol (2010) 404, p. 381-391.
Theurillat et al., "Designed ankyrin repeat proteins: a novel tool for testing epidermal growth factor receptor 2 expression in breast cancer", Modern Pathology (2010), p. 1-9.
Zahnd et al., "Efficient Tumor Targeting with High-Affinity Designed Ankyrin Repeat Proteins: Effects of Affinity and Molecular Size", Cancer Res (2010) 70(4), p. 1595-1605 (incl. Supplement).
Zahnd et al., "Ribosome display: selecting and evolving proteins in vitro that specifically bind to a target," Nature Methods (2007) 4(3), p. 269-279.
Frejd F.Y., "Half-life Extension by Binding to to Albumin through an Albumin Binding Domain", Therapeutic Proteins: Strategies to Modulate Their Plasma Half-lives, Wiley-Blackwell, ed. Kontermann (2012), p. 269-283.
Nguyen et al., "The pharmacokinetics of an albumin-binding Fab (Ab.Fab) can be modulated as a function of affinity for albumin", Prot Eng (2006) vol. 19 No. 7, p. 291-297.
Hopp et al., "The effects of affinity and valency of an albumin-binding domain (ABD) on the half-life of a single-chain diabody-ABD fusion protein", Prot Eng (2010), 23(10) p. 827-834.
Ferrara et al., "Angiogenesis as a therapeutic target", Nature (2005) vol. 438, p. 967-974.
Hurwitz Herbert, "Integrating the Anti-VEGF-A Humanized Monoclonal Antibody Bevacizumab with Chemotherapy in Advanced Colorectal Cancer", Clin. Col. Cancer (2004), 4(Suppl. 2), p. 530-531.
Weis and Cheresh, "Tumor angiogenesis: molecular pathways and therapeutic targets", Nature Medicine (2011) vol. 17, No. 11, p. 1359-1370.
Kerbel, "Tumor Angiogenesis", N Engl J Med. (2008), vol. 358, No. 19, p. 2039-2049.
Comoglio et al., "Drug development of MET inhibitors: targeting oncogene addiction and expedience", Nat. Rev. Drug Discov. (2008) vol. 7, p. 504-516.
Rong et al., "Invasiveness and metastasis of NIH 3T3 cells induced by Met-hepatocyte growth factor / scatter factor autocrine stimulation", Proc. Natl. Acad. Sci. USA (1994), vol. 91, p. 4731-4735.
Michieli et al., "Targeting the tumor and its microenvironment by a dual-function decoy Met receptor", Cancer Cell (2004), vol. 6, p. 61-73.
Fasolo et al., "Seminars in clinical pharmacology: an introduction to MET inhibitors for the medical oncologist", Ann. of Oncology (2013), vol. 24, No. 1, p. 14-20.
Jahangiri et al., "Gene Expression Profile Identifies Tyrosine Kinase c-Met as a Targetable Mediator of Antiangiogenic Therapy Resistance", Clin. Cancer Res. (2013), vol. 19, No. 7, p. 1773-1783.
Sharma et al., "VEGF/VEGFR Pathway Inhibitors as Anti-Angiogenic Agents: Present and Future", Curr. Cancer Drug Targets (2011), vol. 11, p. 624-653.
Yakes et al., "Cabozantinib (XL184), a Novel MET and VEGFR2 Inhibitor, Simultaneously Suppresses Metastasis, Angiogenesis, and Tumor Growth", Mol. Cancer Th. (2011), vol. 10, No. 12, p. 2298-2308.
Castellone et al., "Receptor tyrosine kinase inhibitors in thyroid cancer", Best Pract. Res. Clin. Endocrinol. Metab. (2008) vol. 22, No. 6, p. 1023-1038.
Smith et al., "Cabozantinib in Patients With Advanced Prostate Cancer: Results of a Phase II Randomized Discontinuation Trial", J. Clin. Oncol. (2013), vol. 31, No. 4, p. 412-419.
Main et al., "Design of Stable α-Helical Arrays from an Idealized TPR Motif", Structure (2003), vol. 11, p. 497-508.
Niesen et al., "The use of differential scanning fluorimetry to detect ligand interactions that promote protein stability", Nature (2007), vol. 2, No. 9, p. 2212-2221.
Chen et al., "Fusion protein linkers: effects on production, bioactivity, and pharmacokinetics," Fusion Protein Technologies for Biopharmaceuticals: Applications and Challenges, First Edition, John Wiley & Sons, Inc., ed.: Schmidt, (2013), p. 57-73.
Jonsson et al., "Engineering of a femtomolar affinity binding protein to human serum albumin," Prot Eng Des Sel (2008), 21(8); 512-527.
Naldini et al., "Scatter factor and hepatocyte growth factor are indistinguishable ligands for the MET receptor," The EMBO Journal, (1991), 10(10); 2867-2878.
Nygren et al., "In Vivo Stabilization of a Human Recombinant CD4 Derivative by Fusion to a Serum-albumin-binding Receptor," Vaccines 91, Cold Spring Harbor Laboratory Press (1991), p. 363-368.
Stahl et al., "Highly potent VEGF-A-antagonistic DARPins as anti-angiogenic agents for topical and intravitreal applications," Angiogenesis (2013) 16(1); 101-111.
Wilson et al., "Widespread potential for growth-factor-driven resistance to anticancer kinase inhibitors," Nature (2012) 487(7408);505-509.
Xin et al., "Hepatocyte Growth Factor Enhances Vascular Endothelial Growth Factor-Induced Angiogensis in Vitro and in Vivo," American Journal of Pathology (2001), 158(3); 111-1120.
Fiedler et al, "Antitumor activity of MP0250, a bispecific VEGF- and HGF-targeting darpin, in patient-derived xenograft models", ASCO Annual Meeting, J. Clin. Oncol. (2014), vol. 32, No. 5s (suppl; Abstract No. 11039).
Skrlec et al, "Non-immunoglobulin scaffolds: a focus on their targets", Trends in Biotechnology (2015), vol. 33, No. 7, p. 408-418.

(56) References Cited

OTHER PUBLICATIONS

Klöhn et al, "IBC's 23rd Annual Antibody Engineering, 10th Annual Antibody Therapeutics International Conferences and the 2012 Annual Meeting of The Antibody Society, Dec. 3-6, 2012, San Diego, CA", mAbs, (2012) vol. 5, No. 2, p. 178-201.

Jan. 15, 2015, "DARPin preparation related ankyrin repeat domain, Seq 51.", XP002744973, retrieved from EBI accession No. GSP:BBQ86961; Database accession No. BBQ86961.

Jan. 15, 2015, "DARPin preparation related ankyrin repeat domain, Seq 48.", XP002744974, retrieved from EBI accession No. GSP:BBQ86958, Database accession No. BBQ86958.

Aug. 5, 2010, "Ankyrin repeat domain protein, Seq ID 18.", XP002744975, retrieved from EBI accession No. GSP:AYD11297, Database accession No. AYD11297.

Jul. 19, 2012, "Designed ankyrin repeat protein (DARPin) protein DARPin #46, Seq:46.", XP002744976, retrieved from EBI accession No. GSP:AZW76566, Database access. No. AZW7656.

Jul. 19, 2012, "Designed ankyrin repeat protein (DARPin) protein DARPin #24, Seq:24.", XP002744977, retrieved from EBI accession No. GSP:AZW76544, Database access. No. AZW76544.

RECOMBINANT PROTEINS THAT SIMULTANEOUSLY BIND HGF, VEGF-A AND SERUM ALBUMIN, COMPRISING ANKYRIN REPEAT DOMAINS

CROSS-REFERENCE TO RELATED APPLICATIONS

The present application claims the benefit of and the priority to European patent application EP 15162502, filed Apr. 2, 2015, with the European Patent Office. The present application also claims the benefit of and the priority to European patent application EP 15162511, filed Apr. 2, 2015, with the European Patent Office. The contents of European patent applications EP 15162502 and EP 15162511 are incorporated herein by reference for all purposes in their entireties.

FIELD OF THE DISCLOSURE

Provided is a new designed ankyrin repeat domain with binding specificity for serum albumin exhibiting improved storage stability properties. Provided are also recombinant binding proteins comprising at least two designed ankyrin repeat domains with binding specificity for serum albumin, which exhibit improved pharmacokinetic properties compared to the recombinant binding proteins comprising only one designed ankyrin repeat domain with binding specificity for serum albumin. Particularly provided are recombinant binding proteins comprising at least one designed ankyrin repeat domain with binding specificity for hepatocyte growth factor (HGF), comprising at least one designed ankyrin repeat domain with binding specificity for vascular endothelial growth factor A (VEGF-A), and comprising at least two designed ankyrin repeat domains with binding specificity for serum albumin. Furthermore provided are nucleic acids encoding such designed ankyrin repeat domains and/or recombinant binding proteins, pharmaceutical compositions comprising such designed ankyrin repeat domains, recombinant binding proteins or nucleic acids, and the use of such designed ankyrin repeat domains, recombinant binding proteins, nucleic acids, or pharmaceutical compositions in the treatment of a disease.

BACKGROUND

The following discussion of the background is merely provided to aid the reader in understanding the invention and is not admitted to describe or constitute prior art to the present invention.

There are, beside antibodies, novel binding proteins or binding domains that can be used to specifically bind a target molecule (e.g. Binz, H. K., Amstutz, P., Plückthun, A., Nat. Biotechnol. 23, 1257-1268, 2005). One such novel class of binding proteins or binding domains not possessing an Fc are based on designed repeat proteins or designed repeat domains, such as designed ankyrin repeat proteins or designed ankyrin repeat domains (WO 2002/020565; Binz, H. K., Amstutz, P., Kohl, A., Stumpp, M. T., Briand, C., Forrer, P., Gruner, M. G., Pluckthun, A., Nat. Biotechnol. 22, 575-582, 2004). WO 2002/020565 describes how large libraries of repeat proteins, such as ankyrin repeat proteins, can be constructed, and their general application. WO 2012/069654 describes recombinant binding proteins comprising a designed ankyrin repeat domain with binding specificity for serum albumin. WO 2010/060748 describes recombinant binding proteins comprising designed ankyrin repeat domains with binding specificity for VEGF-A, and WO 2011/135067 describes modified versions of such recombinant binding proteins specific for binding to VEGF-A. WO 2014/191574 describes recombinant binding proteins comprising designed ankyrin repeat domains with binding specificity for HGF. None of these patent applications discloses a recombinant binding protein comprising a designed ankyrin repeat domain with binding specificity for VEGF-A and a designed ankyrin repeat domain with binding specificity for HGF.

Unlike e.g. IgG antibodies, which exhibit long systemic half-lives mediated by FcRn recycling, proteins comprising designed ankyrin repeat domains typically exhibit a fast pharmacokinetic clearance and short terminal half-lives, unless the protein comprises elements that improve the pharmacokinetic properties, such as e.g. a designed ankyrin repeat domain with binding specificity to serum albumin described in WO 2012/069654. Using serum albumin binding for improving pharmacokinetic properties of proteins is a process well-known in the art (see e.g. WO 9101743; Frejd F. Y., 2012 (in Kontermann, R (Ed.) "Therapeutic proteins: strategies to modulate their plasma half-lives", Wiley-VCH Verlag GmbH, 2012, ISBN 978-3-527-32849-9); Nguyen, A., Reyes, A. E. II., Zhang, M., McDonald, P., Wong, W. L., Damico, L. A., Dennis, M. S. Protein Eng. Des. Sel. 19, 291-297, 2006; WO 2008/096158; WO 2006/122787; WO 2011/095545; and WO 2012/069654). In order to be able to use designed ankyrin repeat domains with binding specificity for serum albumin in clinical drug candidates, the storage stability of known designed ankyrin repeat domains with binding specificity for serum albumin has to be improved. Disclosed herein are designed ankyrin repeat domains with binding specificity for serum albumin with improved properties.

The effect of valency of designed ankyrin repeat domains with binding specificity for serum albumin on the pharmacokinetic properties of recombinant binding proteins has not been investigated. Based on findings of the albumin binding domain (Hopp, J., Horning, N., Zettlitz, K. A., Schwarz, A., Fuss, N., Müller, D., Kontermann, R. E. Protein Eng. Des. Sel. 23, 827-834, 2010), one skilled in the art would expect that a recombinant binding protein comprising two albumin binding protein domains such as designed ankyrin repeat domains with binding specificity for serum albumin would not have improved pharmacokinetic properties compared to a recombinant binding protein comprising only one designed ankyrin repeat domain with binding specificity for serum albumin. Surprisingly, we found that this is not the case. Disclosed are thus recombinant binding proteins comprising at least two designed ankyrin repeat domains with binding specificity for serum albumin that exhibit improved pharmacokinetic properties (i.e. prolonged terminal half-lives, increased exposures, reduced clearance, and/or increased percentages of injected dose) compared to recombinant binding proteins comprising only one designed ankyrin repeat domain with binding specificity for serum albumin.

Neovascularisation (new blood vessel formation) is widely known to play an important role in the development and maintenance of tumors (Ferrera, N., and Kerbel, R. S., Nature 438, 967-974, 2005). Accordingly, the inhibition of angiogenesis has become a main cornerstone in modern clinical oncology; especially the targeting of vascular endothelial growth factor (VEGF) and its receptors (Hurwitz, H., Clin. Colorectal Cancer, Suppl. 2, 62-68, 2004; Escudier, B., Clin. Adv. Hematol. Oncol. 5, 530-531, 2007). The mammalian VEGF family consists of five glycoproteins referred to as VEGF-A, VEGF-B, VEGF-C, VEGF-D (also known as FIGF) and placenta growth factor (PlGF, also known as PGF). VEGF-A has been shown to be an effective target for anti-angiogenic therapy (Weis, S. M., and Cheresh, D. A., Nat. Med. 17, 1359-1370, 2011). The VEGF-A ligands bind to and activate three structurally similar type III receptor tyrosine kinases, designated VEGFR-1 (also known as FLT1), VEGFR-2 (also known as KDR) and VEGFR-3 (also known as FLT4). Several angiogenesis inhibitors have received regulatory approval to date showing a prolonged progression-free survival (PFS) and/or overall survival in various cancer types in combination with chemotherapy. Unfortunately, resistance inevitably occurs during the course of treatment with VEGF/VEGFR inhibitors, such as the VEGF-A inhibitor bevacizumab (Avastin®), suggesting that concomitant inhibition of additional targets and resistance pathways may be necessary to achieve superior clinical results (Kerbel, R. S., N. Engl. J. Med. 358, 2039-2049, 2008; Hurwitz, 2004, loc. cit.; Escudier, 2007, loc. cit.). cMet tyrosine kinase is a cell surface receptor for hepatocyte growth factor (HGF, also known as scatter factor, SF) primarily expressed on epithelial cells (Comoglio, P. M., Giordano, S., and Trusolino, L., Nat. Rev. Drug Discov. 7, 504-516, 2008). While cMet and HGF are expressed at low levels in normal adult tissues, their expression is frequently up regulated in a broad range of human tumors, which has been correlated in preclinical models with tumor cell survival, growth, angiogenesis, invasion and metastasis (Rong, S., Segal, S., Anver, M., Resau, J. H., Vande Woude, G. F., Proc. Natl. Acad. Sci. USA 91, 4731-4735, 1994; Michieli, P., Mazzone, M., Basilico, C., Cavassa, S., Sottile, A., Naldini, L., Comoglio, P. M., Cancer Cell 6, 61-73, 2004). Up-regulation of HGF and/or cMet expression and signaling has been found to be associated with poor prognosis and drug resistance in many tumor types in the clinic (Fasolo, A., Sessa, C., Gianni, L., Broggini, M., Ann. Oncol. 24, 14-20, 2013). Altogether this indicates that the HGF-cMet axis is an important target for therapeutic intervention (Comoglio, 2008 loc. cit.; Fasolo et al., 2013, loc. cit.). Through binding to its receptor, HGF mediates a number of cellular responses, including scattering of various cell types, the formation of tubules and lumens, epithelial-mesenchymal transition, angiogenesis, liver regeneration, wound healing and embryological development. The HGF/c-Met signaling pathway has also been shown to play a role in various diseases, including many human solid tumors, in which it participates in tumor development, invasion and metastasis. Current HGF/cMet pathway inhibitors in phase II or III clinical development comprise monoclonal antibodies (mAbs) targeting the extracellular domain of cMet (i.e. MetMab from Genentech-Roche) or small molecule inhibitors of its intracellular kinase domain. Small molecule inhibitors such as tivantinib (ArQule®) and cabozantinib (Cometriq®) are very potent but less specific than mAbs and bear the potential for higher toxicity. Biological agents against HGF/SF include rilotumumab (AMG102), a humanised mAb against HGF, and ficlatuzumab (AV-299), a humanised anti-HGF IgG1. The use of HGF/cMet inhibitors in combination with other targeted agents is an active field of investigation which aims to simultaneously inhibit various signaling pathways that have redundant or synergistic tumor functions. HGF/cMet triggers potent angiogenic signals that act synergistically with VEGF in inducing new tumor blood vessels and can induce resistance to anti-angiogenic therapy such as Avastin® and Sutent® (sunitinib) in glioblastoma (Jahangiri, A., De Lay, M., Miller, L. M., Carbonell, W. S., Hu, Y. L., Lu, K., Tom, M. W., Paquette, J., Tokuyasu, T. A., Tsao, S., Marshall, R., Perry, A., Bjorgan, K. M., Chaumeil, M. M., Ronen, S. M., Bergers, G., Aghi, M. K., Clin. Cancer Res. 19, 1773-1783, 2013) and renal cell cancer, respectively.

There are currently a number of anti-HGF/cMet compounds under investigation in combination with other targeted agents such as anti-VEGF receptor inhibitors, which have demonstrated a favorable safety profile in a variety of tumor types (Sharma, P. S., Sharma, R., Tyagi, T. Curr. Cancer Drug Targets. 11, 624-653, 2011). However, such combination therapy approaches imply that the patient must receive two separate treatments, each with a different safety profile, which may lead to increased undesirable toxicities, which in turn may limit the medical treatment options. Furthermore, different treatments may be subjected to different administration schemes, which could make the dosing more burdensome for the patient. Last but not least, the dosing of various agents simultaneously may significantly increase the costs associated to treatment and patient care.

One commercially available drug with dual cMet and VEGF inhibitory activity is cabozantinib (Cometriq®; a small molecule drug), an oral, multi-specific tyrosine kinase inhibitor targeting cMet and VEGFR 1-3 (in addition to RET, KIT, AXL and FLT3). Cabozantinib has validated the clinical approach of simultaneously inhibiting HGF and VEGF in tumors with a single agent (Yakes, F. M., Chen, J., Tan, J., Yamaguchi, K., Shi, Y., Yu, P., Qian, F., Chu, F., Bentzien, F., Cancilla, B., Orf, J., You, A., Laird, A. D., Engst, S., Lee, L., Lesch, J., Chou, Y. C., Joly, A. H., Mol. Cancer Ther. 10, 2298-2308, 2011; Castellone, M. D., Carlomagno, F., Salvatore, G., Santoro, M., Best Pract. Res. Clin. Endocrinol. Metab. 22, 1023-1038, 2008). For instance, in castration resistant prostate cancer, an indication where the anti-HGF mAb rilotumumab failed to demonstrate efficacy as single agent in phase II studies, cabozantinib showed anti-tumor activity in a high percentage of patients in phase II (Smith, D. C., Smith, M. R., Sweeney, C., Elfiky, A. A., Logothetis, C., Corn, P. G., Vogelzang, N. J., Small, E. J., Harzstark, A. L., Gordon, M. S., Vaishampayan, U. N., Haas, N. B., Spira, A. I., Lara, P. N. Jr., Lin, C. C., Srinivas, S., Sella, A., Schöffski, P., Scheffold, C., Weitzman, A. L., Hussain, M., J. Clin. Oncol. 31, 412-419, 2013). However, activity was paralleled with a high incidence of adverse events that led to dose reductions in 62% of patients, raising doubts on the safety and tolerability of such pleiotropic modes of action.

Simultaneous targeting of VEGF-A and HGF/cMet may beneficially disrupt angiogenesis and tumor progression. As described hereinbefore, current therapies acting simultaneously on the VEGF-A/VEGFR-2 and the HGF/cMet-pathways either are based on single therapeutics that are unspecific and lead to safety findings, or involve several specific therapeutics that have to be combined, resulting in a need of co-administration or multiple administrations. Furthermore, some of the current drugs exhibit short systemic half-lives. Thus, there is a need to provide improved drugs blocking the VEGF-A/VEGFR-2 and the HGF/cMet pathways. This is technically difficult to achieve with antibody drugs, which further suffer from the need of laborious production in mammalian cells. Provided herein are recombinant binding proteins that address these issues. In some embodiments a recombinant binding protein provided herein comprises at least one designed ankyrin repeat domain with binding specificity for VEGF-A, at least one designed ankyrin repeat domain with binding specificity for HGF, and, for pharmacokinetic property improvement, at least two designed ankyrin repeat domains with binding specificity for serum albumin.

SUMMARY

The present invention relates to a new designed ankyrin repeat domain with binding specificity for serum albumin comprising the amino acid sequence of SEQ ID NO: 50, which exhibits improved storage stability over known designed ankyrin repeat domains with binding specificity for serum albumin. In one embodiment, the invention relates to a recombinant binding protein comprising at least two designed ankyrin repeat domains with binding specificity for serum albumin, wherein said designed ankyrin repeat domains with binding specificity for serum albumin each comprise SEQ ID NO: 50. In one embodiment, the invention relates to a recombinant binding protein comprising a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin and comprise the amino acid sequence of SEQ ID NO: 50. In one embodiment, said first, second, third and fourth designed ankyrin repeat domains of said recombinant binding protein are in the order third-second-first-fourth from N terminus to C terminus. In one embodiment, said first designed ankyrin repeat domain of said recombinant binding protein comprises an amino acid sequence selected from the group consisting of amino acid sequences SEQ ID NOs: 12 to 21 and amino acid sequences in which up to 10 amino acids of SEQ ID NOs: 12 to 21 are exchanged by any amino acid, and said second designed ankyrin repeat domain of said recombinant binding protein comprises an amino acid sequence selected from the group consisting of amino acid sequences SEQ ID NOs: 23 to 37 and amino acid sequences in which up to 10 amino acids of SEQ ID NOs: 23 to 37 are exchanged by any amino acid, and said third and fourth designed ankyrin repeat domains of said recombinant binding protein each comprise amino acid sequence SEQ ID NO: 50, and said designed ankyrin repeat domains are linked by polypeptide linkers comprising amino acid sequences selected from the group consisting of amino acid sequences SEQ ID NOs: 2 to 9 and amino acid sequences in which up to 4 amino acids of SEQ ID NOs: 2 to 9 are exchanged by any amino acid. In one embodiment, said first designed ankyrin repeat domain of said recombinant binding protein comprises amino acid sequences SEQ ID NO: 18, and said second designed ankyrin repeat domain of said recombinant binding protein comprises amino acid sequence SEQ ID NO: 26, and said third and fourth designed ankyrin repeat domains of said recombinant binding protein each comprise amino acid sequence SEQ ID NO: 50, and said designed ankyrin repeat domains are linked by polypeptide linkers consisting of amino acid sequence SEQ ID NO: 9. In one embodiment, the invention relates to a recombinant binding protein comprising an amino acid sequence that has at least 90% amino acid sequence identity with the amino acid sequence of SEQ ID NO: 134. In one embodiment, the invention relates to a recombinant binding protein comprising the amino acid sequence consisting of the amino acid sequence of SEQ ID NO: 134. In a preferred embodiment, the invention relates to a recombinant binding protein consisting of the amino acid sequence of SEQ ID NO: 134.

The invention further relates to a nucleic acid encoding the amino acid sequence of a designed ankyrin repeat domain or a recombinant binding protein of the invention.

The invention also relates to a pharmaceutical composition comprising a recombinant binding protein and/or a designed ankyrin repeat domain or a nucleic acid of the present invention, and optionally a pharmaceutical acceptable carrier and/or diluent.

The invention also relates to the use of the pharmaceutical composition of the invention for the treatment of a disease. In one embodiment, it relates to the use of the pharmaceutical composition of the invention for the treatment of cancer, gastric cancer, or renal cancer.

BRIEF DESCRIPTION OF THE FIGURES

FIG. 1A shows an illustration of a designed ankyrin repeat domain with binding specificity for serum albumin. Examples of such ankyrin repeat domains are designed ankyrin repeat domains with an amino acid sequence selected from the group consisting of SEQ ID NOs: 40 to 56, in particular the designed ankyrin repeat domain with amino acid sequence of SEQ ID NO: 50.

FIG. 1B shows an illustration of a designed ankyrin repeat domain with binding specificity for another target than serum albumin. Examples of such ankyrin repeat domains are designed ankyrin repeat domains with an amino acid sequence selected from the group consisting of SEQ ID NOs: 12 to 39.

FIG. 1C shows an illustration of a polypeptide linker (for example a polypeptide with an amino acid sequence corresponding to any of SEQ ID NOs: 2 to 9).

FIG. 1D shows an illustration of an N-terminal amino acid sequence. Examples for such N-terminal amino acid sequences are for example the sequences MGS or GS, or polypeptide tags, as exemplified by the amino acid sequence corresponding to SEQ ID NO: 1.

FIG. 1E shows an illustration of a bioactive compound. Such a moiety can for example be a protein or protein domain with e.g. agonistic (e.g. hormone, or enzyme), antagonistic (e.g. receptor domain or antibody fragment), or toxic (e.g. toxin) activity. Such a moiety can for example also be a small molecule compound exhibiting e.g. agonistic, antagonistic, or toxic activity.

FIG. 1F. shows an illustration of a recombinant binding protein provided herein comprising two designed ankyrin repeat domains with binding specificity for serum albumin, and one designed ankyrin repeat domain with binding specificity for another target than serum albumin, linked by polypeptide linkers and having an N-terminal amino acid sequence. For example a recombinant binding protein with an amino acid sequence corresponding to any of SEQ ID NOs: 73 to 81 consist of such three designed ankyrin repeat domains, wherein SEQ ID NOs: 73, 75, 78, and 80 have the two designed ankyrin repeat domains with binding specificity for serum albumin flanking the respective third designed ankyrin repeat domain as shown in the illustration.

FIG. 1G. shows an illustration of a recombinant binding protein provided herein comprising two designed ankyrin repeat domains with binding specificity for serum albumin, and two designed ankyrin repeat domains with binding specificities for other targets than serum albumin, linked by polypeptide linkers and having an N-terminal amino acid sequence. The two designed ankyrin repeat domains with binding specificity for serum albumin are flanking the two other designed ankyrin repeat domains. For example a recombinant binding protein with an amino acid sequence corresponding to any of SEQ ID NOs: 95 to 107, 110, 116, 122, 129 to 131, 134 to 144, 149 to 172, and 175 to 179, in particular SEQ ID NO: 134 corresponds to this illustration.

FIG. 1H shows an illustration of a recombinant binding protein provided herein comprising two designed ankyrin repeat domains with binding specificity for serum albumin, and two designed ankyrin repeat domains with binding specificities for other targets than serum albumin, linked by polypeptide linkers and having an N-terminal amino acid sequence. The two designed ankyrin repeat domains with binding specificity for serum albumin are N-terminal to the two other designed ankyrin repeat domains. For example a recombinant binding protein with an amino acid sequence corresponding to any of SEQ ID NOs: 112, 119, 124, 128, 132, and 133 corresponds to this illustration.

FIG. 1I. shows an illustration of a pharmaceutical compound comprising two designed ankyrin repeat domains with binding specificity for serum albumin and a bioactive compound. The bioactive compound can be covalently linked to the two designed ankyrin repeat domains with binding specificity for serum albumin by means of chemical coupling or, in the case of polypeptides, protein fusion.

FIG. 3A shows the pharmacokinetic profile comparison of Protein #57 (single designed ankyrin repeat domain with binding specificity for serum albumin; SEQ ID NO: 57, which comprises SEQ ID NO: 51; filled circles) with Proteins #62 and #63 (proteins comprising two designed ankyrin repeat domains with binding specificity for serum albumin (twice SEQ ID NO: 51), linked by GS—(SEQ ID NO: 63; filled diamonds) or PT-rich (SEQ ID NO: 62; filled squares) polypeptide linkers). Having two designed ankyrin repeat domains with binding specificity for serum albumin leads to higher % ID at e.g. 24 h (+57% GS; +59% PT), 48 h (+76% GS; +82% PT) or 72 h (+79% GS; +94% PT) post-injection, and leads to an improved terminal half-life (+38% GS; +48% PT) compared to the protein comprising only a single designed ankyrin repeat domain with binding specificity for serum albumin.

FIG. 3B shows the pharmacokinetic profile comparison of Protein #64 (filled circles), comprising SEQ ID NOs: 22 (designed ankyrin repeat domain with binding specificity for another target than serum albumin) and 51 (designed ankyrin repeat domain with binding specificity for serum albumin), with Proteins #73 (filled squares) and #74 (filled diamonds), comprising each SEQ ID NOs: 22 and two times 51. Protein #73 has SEQ ID NOs: 51 flanking SEQ ID NO: 22, and Protein #74 has twice SEQ ID NOs: 51 N-terminal of SEQ ID NO: 22. Having two designed ankyrin repeat domains with binding specificity for serum albumin leads to higher % ID at e.g. 24 h (+62% N-terminal; +89% flanking), or 48 h (+136% N-terminal; +175% flanking) post-injection, and leads to an improved terminal half-life (+>63% for both N-terminal or flanking) compared to the protein comprising only a single designed ankyrin repeat domain with binding specificity for serum albumin.

FIG. 3C shows the pharmacokinetic profile comparison of Protein #82 (filled circles), comprising SEQ ID NOs: 11 (twice; designed ankyrin repeat domain with no known binding specificity) and 51 (designed ankyrin repeat domain with binding specificity for serum albumin), with Protein #109 (filled squares) comprising SEQ ID NOs: 11 (twice) and 51 (twice; N-terminal). Having two designed ankyrin repeat domains with binding specificity for serum albumin leads to higher % ID at e.g. 24 h (+12%), or 48 h (+35%) post-injection, and leads to an improved terminal half-life (+71%) compared to the protein comprising only a single designed ankyrin repeat domain with binding specificity for serum albumin.

FIG. 3D shows the pharmacokinetic profile comparison of Protein #83 (filled circles), comprising SEQ ID NOs: 38 and 39 (designed ankyrin repeat domains each with binding specificity for another target than serum albumin) and 50 (designed ankyrin repeat domain with binding specificity for serum albumin), with Proteins #110 (filled squares), comprising each SEQ ID NOs: 38, 39 and 50 (twice; flanking SEQ ID NOs: 38 and 39). Having two designed ankyrin repeat domains with binding specificity for serum albumin leads to higher % ID at e.g. 24 h (+198%), 48 h (+198%), or 72 h (+228%) post-injection, and leads to an improved terminal half-life (+19%) compared to the protein comprising only a single designed ankyrin repeat domain with binding specificity for serum albumin. Note that the measurement of Protein #83 was close to the lower limit of quantification.

FIG. 4A shown the pharmacokinetic profile comparison of Protein #57 (0.5 mg/Kg; 27.7 nmol/kg; single designed ankyrin repeat domain with binding specificity for serum albumin; SEQ ID NO: 57, which comprises SEQ ID NO: 51; filled circles) with Protein #62 (1.04 mg/Kg; 34.5 nmol/kg; protein comprising two designed ankyrin repeat domains with binding specificity for serum albumin (twice SEQ ID NO: 51), linked by a PT-rich polypeptide linker). Having two designed ankyrin repeat domains with binding specificity for serum albumin leads to higher exposure (2138 d*nmol/L vs. 4676 d*nmol/L, i.e. +119% calculated up to day 7), leads to a reduced clearance (0.0108 L/(d*kg) vs. 0.0031 L/(d*kg); i.e. −71%), and leads to an improved terminal half-life (4.57 d vs. 9.00 d, i.e. +97% calculated from day 1 to day 7) compared to the protein comprising only a single designed ankyrin repeat domain with binding specificity for serum albumin.

FIG. 4B shows the pharmacokinetic profile of Protein #97 (a recombinant binding protein consisting of the amino acid sequence of SEQ ID NO: 97; filled squares) and Protein #134 (a recombinant binding protein consisting of the amino acid sequence of SEQ ID NO: 134, with no additional sequence tag; filled circles) administered at 1 mg/kg i.v. to cynomolgus monkeys are shown. Protein #134 has an improved pharmacokinetic profile compared to Protein #97.

FIG. 7A shows the results of a VEGF-A/VEGFR-2 HTRF binding competition assay. Protein #134 inhibits the VEGF-A/VEGFR-2 interaction. Baseline is indicated by the dashed line, no competition signal is indicated by the circular symbol. R: ratio 665 nm signal to 620 nm signal, c: concentration of Protein #134 in nM.

FIG. 7B shows the results of a HGF/cMet competition binding assay. Protein #134 inhibits the HGF/cMet interaction. OD: OD at 450 nm minus OD at 620 nm, c: concentration of Protein #134 in nM.

FIG. 7C shows the results of a VEGF-A competition binding ELISA. Protein #134 binds VEGF-A with an $IC_{50}$ of better than 10 pM. OD: OD at 450 nm minus OD at 620 nm, c: concentration of Protein #134 in pM.

FIG. 9A shows inhibition of proliferation of HUVECs by Protein #134. HUVECs ($3 \times 10^3$ cells/well) were stimulated by 8 ng/mL human VEGF-A. Proliferative status of HUVECs was analyzed in the absence (open circle) or presence of increasing concentrations of Protein #134 (filled circles). After 3 days of cultivation at 37° C. and 5% $CO_2$, inhibition was quantified by addition of BrdU for the last 24 h of incubation. Protein #134 exhibits an $IC_{50}$ in the range of 100-150 pM. Error bars reflect standard deviation of independent duplicates. OD: OD at 450 nm minus OD at 620 nm, c: concentration of Protein #134 in ng/ml. The X axis is shown in logarithmic scale.

FIG. 9B shows the effect of Protein #134 in an Oris cell migration assay with A549 cells. Protein #134 significantly inhibits the HGF-induced cell migration. Cells were seeded 24 h prior to stimulation with HGF (500 μM; H and D) or PBS (N), in the presence (D) and absence (H, N) of Protein #134 (5 μM). The stoppers were removed and migration was detected and quantified 48 h later after staining of cells with Calcein. Images were taken and the uncovered area in the cell culture plate well quantified. U: Uncovered area in 8 independent wells in $\mu m^2$, H: HGF, no Protein #134, N: No HGF, no Protein #134, D: HGF & Protein #134.

FIG. 9C shows inhibition of cMet phosphorylation in A549 cells by Protein #134. A549 cells were starved overnight and stimulated with 1 nM human HGF (no HGF for negative control) in presence of PBS or increasing concentrations of Protein #134 for 10 minutes. P-cMet was detected in cell lysates by ELISA measuring OD450-620. Relative signals (% phosphorylation) were calculated using maximal signal (HGF, no Protein #134) and minimal signal (no HGF, no Protein #134). Protein #134 inhibits cMet phosphorylation with an $IC_{50}$ of better than 1 nM. % P: % phosphorylation, c: concentration of Protein #134 in nM.

FIG. 10A shows the quantification of proliferative cells and mean vascular area in tumor tissue of a U87M mouse model treated with Protein #134, Protein #60 (a recombinant binding protein consisting of the amino acid sequence of SEQ ID NO: 60 and additionally having SEQ ID NO: 1 at the N-terminus; comprises one designed ankyrin repeat domain with binding specificity for HGF (identical to the one in Protein #134), and one designed ankyrin repeat domain with binding specificity for serum albumin (identical to the one in Protein #134)), or Protein #61 (a recombinant binding protein consisting of the amino acid sequence of SEQ ID NO: 61 and additionally having SEQ ID NO: 1 at the N-terminus; comprises one designed ankyrin repeat domain with binding specificity for VEGF-A (identical to the one in Protein #134), and one designed ankyrin repeat domain with binding specificity for serum albumin (identical to the one in Protein #134)), as described in Example 14. Regarding inhibition of the proliferation of U87M tumor xenograft cells (P; measured as percent proliferative cells, % pc), Protein #60 exhibits a slight inhibition, similar as Protein #61, whereas Protein #134 has a significantly stronger effect. Likewise, regarding inhibition of vascular growth (A; measured as mean vascular area percentage; % mva), Protein #60 exhibits a slight inhibition, Protein #61 exhibits an intermediate inhibition, and Protein #134 exhibits the strongest effect. PBS (white bars), Protein #60 (horizontally striped bars), Protein #61 (vertically striped bars), Protein #134 (black bars).

FIG. 10B shows the effect of Protein #134 on tumor growth in a patient derived renal tumor xenograft mouse model in comparison to sorafenib and PBS. Details of the model are described in Example 14. Sorafenib suppresses tumor growth as expected. Interestingly, Protein #134 suppresses tumor growth beyond the levels of sorafenib, controlling the tumor volume at its initial levels. V: tumor volume in $mm^3$, d: days of treatment, open circles: vehicle, closed circles: Protein #134 (4 mg/kg), open square: sorafenib (200 mg/kg).

FIG. 10C shows the effect of Protein #134 on tumor growth in a patient derived gastric tumor xenograft mouse model in comparison to paclitaxel and a combination of Protein #134 and paclitaxel. Details of the model are described in Example 14. Paclitaxel and Protein #134 suppress tumor growth to about the same level. The combination of Paclitaxel and Protein #134 suppresses tumor growth even more, controlling the tumor volume at its initial levels. V: tumor volume in $mm^3$, d: days post therapy, open circles: vehicle, closed circles: Protein #134 (4 mg/kg i.v.), open square: paclitaxel (15 mg/kg i.v.), open triangles: Protein #134 (4 mg/kg) and paclitaxel (15 mg/kg).

DETAILED DESCRIPTION

Figures 1A, 1B, 1C, 1D, 1E, 1F, 1G, 1H, 1I:
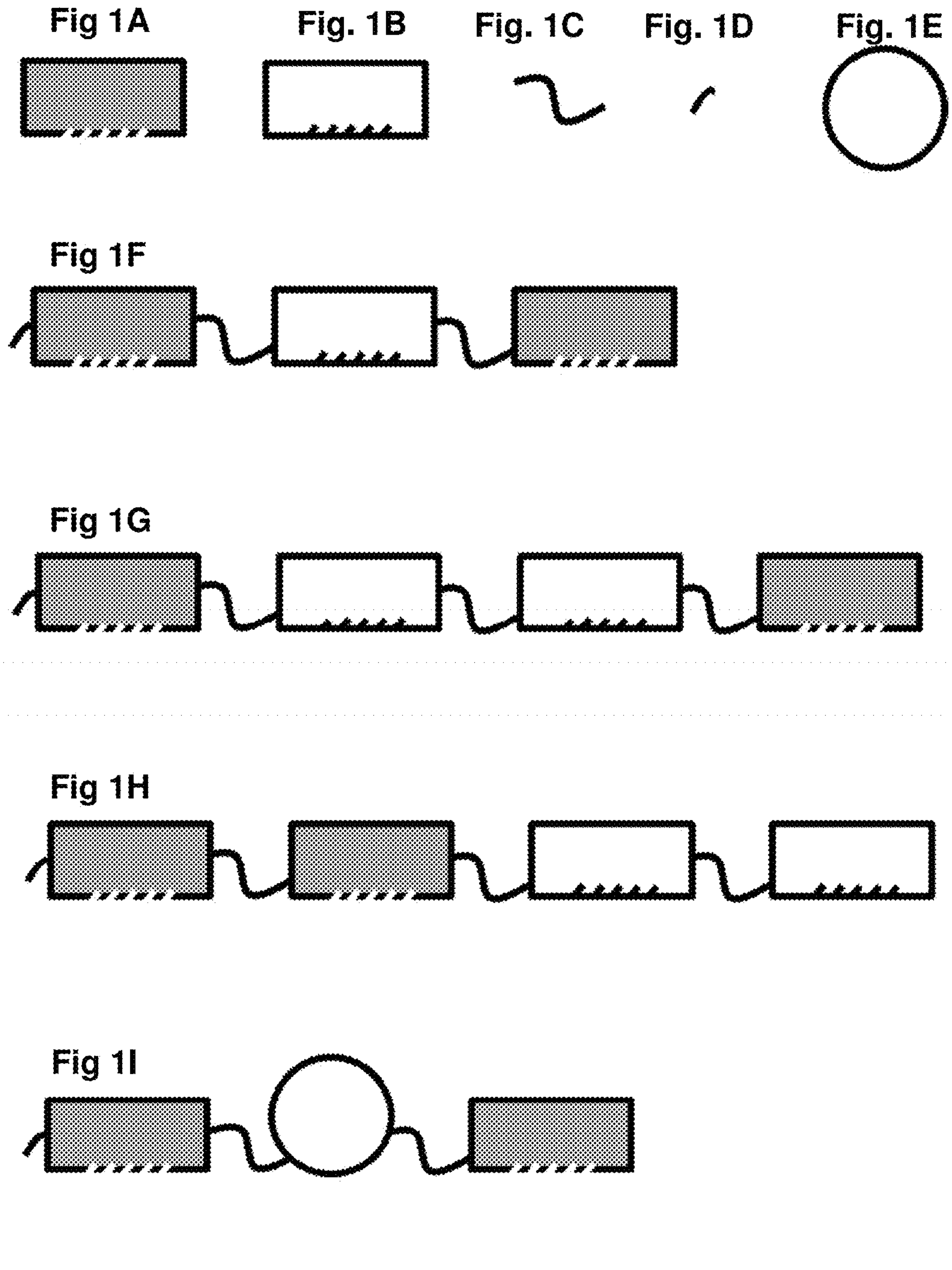
FIG. 1A. Illustration of recombinant binding proteins comprising designed ankyrin repeat domains with binding specificity for serum albumin.
FIG. 1B. Illustration of recombinant binding proteins comprising designed ankyrin repeat domains with binding specificity for serum albumin.
FIG. 1C. Illustration of recombinant binding proteins comprising designed ankyrin repeat domains with binding specificity for serum albumin.
FIG. 1D. Illustration of recombinant binding proteins comprising designed ankyrin repeat domains with binding specificity for serum albumin.
FIG. 1E. Illustration of recombinant binding proteins comprising designed ankyrin repeat domains with binding specificity for serum albumin.
FIG. 1F. Illustration of recombinant binding proteins comprising designed ankyrin repeat domains with binding specificity for serum albumin.
FIG. 1G. Illustration of recombinant binding proteins comprising designed ankyrin repeat domains with binding specificity for serum albumin.
FIG. 1H. Illustration of recombinant binding proteins comprising designed ankyrin repeat domains with binding specificity for serum albumin.
FIG. 1I. Illustration of recombinant binding proteins comprising designed ankyrin repeat domains with binding specificity for serum albumin.

In the context of the present invention the term "protein" refers to a polypeptide, wherein at least part of the polypeptide has, or is able to acquire a defined three-dimensional arrangement by forming secondary, tertiary, or quaternary structures within a single polypeptide chain and/or between multiple polypeptide chains. If a protein comprises two or more polypeptide chains, the individual polypeptide chains may be linked non-covalently or covalently, e.g. by a disulfide bond between two polypeptides. A part of a protein, which individually has, or is able to acquire, a defined three-dimensional arrangement by forming secondary or tertiary structure, is termed "protein domain". Such protein domains are well known to the practitioner skilled in the art.

The term "recombinant" as used in recombinant protein, recombinant protein domain, recombinant binding protein and the like, means that said polypeptides are produced by the use of recombinant DNA technologies well known by the practitioner skilled in the relevant art. For example, a recombinant DNA molecule (e.g. produced by gene synthesis) encoding a polypeptide can be cloned into a bacterial expression plasmid (e.g. pQE30, QIAgen), yeast expression plasmid, mammalian expression plasmid, or plant expression plasmid, or a DNA enabling in vitro expression. If, for example, such a recombinant bacterial expression plasmid is inserted into an appropriate bacteria (e.g. *Escherichia coli*), this bacteria can produce the polypeptide encoded by this recombinant DNA. The correspondingly produced polypeptide is called a recombinant polypeptide or recombinant protein.

In the context of the present invention, the term "binding protein" refers to a protein comprising two or more, preferably three or more, more preferably four or more binding domains. Preferably, said binding protein is a recombinant binding protein. Preferably, said binding protein comprises two or more repeat domains. More preferably, said binding protein comprises three repeat domains. More preferably, said binding protein comprises four repeat domains. Also preferably, said binding protein comprises three or more designed ankyrin repeat domains. Further preferably, said binding protein comprises four or more designed ankyrin repeat domains. More preferably, said binding protein comprises four designed ankyrin repeat domains. Optionally, said binding protein comprises one or more bioactive compound. Said binding domains of said binding protein each have a target specificity. Preferably, two or more of said binding domains of said binding protein each have a target specificity for serum albumin. Preferably, said binding protein comprises at least three binding domains binding to at least two different targets. More preferably, said binding protein comprises at least four binding domains binding to at least three different targets.

Furthermore, any such binding protein may comprise additional polypeptides (such as e.g. polypeptide tags, or polypeptide linkers, well known to the person skilled in the art.

The term "bioactive compound" refers to a compound that is disease modifying when applied to a mammal having said disease. A bioactive compound may have antagonistic or agonistic properties and can be a proteinaceous bioactive compound or a non-proteinaceous bioactive compound. Such proteinaceous bioactive compounds can be covalently attached to, for example, a binding domain of the invention by the generation of genetic fusion polypeptides using standard DNA cloning technologies, followed by their standard expression and purification. Non-proteinaceous bioactive compounds can be covalently attached to, for example, a binding domain of the invention by chemical means, e.g., by coupling to a cysteine thiol via a maleimide linker with a cysteine being coupled via a polypeptide linker to the N or C terminus of a binding domain as described hereinbefore. Examples of proteinaceous bioactive compounds are binding domains having a distinct target specificity (e.g. neutralizing a growth factor by binding to it), cytokines (e.g. interleukins), growth factors (e.g. human growth hormone), antibodies and fragments thereof, hormones (e.g. GLP-1), or a proteinaceous drug. Examples of non-proteinaceous bioactive compounds are toxins (e.g. DM1 from ImmunoGen), small molecules targeting GPCRs, antibiotics or a non-proteinaceous drug.

The term "binding domain" means a protein domain exhibiting the same "fold" (i.e. secondary, tertiary, and/or quaternary structure) as a protein scaffold and having a predetermined property, as defined below. Such a binding domain may be obtained by rational, or most commonly, combinatorial protein engineering techniques, skills which are known in the art (Binz et al., 2005, loc. cit.). For example, a binding domain having a predetermined property can be obtained by a method comprising the steps of (a) providing a diverse collection of protein domains exhibiting the same fold as a protein scaffold as defined further below; and (b) screening said diverse collection and/or selecting from said diverse collection to obtain at least one protein domain having said predetermined property. The diverse collection of protein domains may be provided by several methods in accordance with the screening and/or selection system being used, and may comprise the use of methods well known to the person skilled in the art, such as phage display or ribosome display. Preferably, said binding domain is a recombinant binding domain.

The term "protein scaffold" means a protein with exposed surface areas in which amino acid insertions, substitutions or deletions are highly tolerable. Examples of protein scaffolds that can be used to generate binding domains of the present invention are antibodies or fragments thereof such as single-chain Fv or Fab fragments, protein A from *Staphylococcus aureus*, the bilin binding protein from *Pieris brassicae* or other lipocalins, ankyrin repeat proteins or other repeat proteins, and human fibronectin. Protein scaffolds are known to the person skilled in the art (Binz et al., 2005, loc. cit.; Binz et al., 2004, loc. cit.).

The term "target" refers to an individual molecule such as a nucleic acid molecule, a polypeptide or protein, a carbohydrate, or any other naturally occurring molecule, including any part of such individual molecule, or complexes of two or more of such molecules. A target may be a whole cell or a tissue sample, or it may be any non-natural compound. Preferably, a target is a naturally occurring or non-natural polypeptide or a polypeptide containing chemical modifications, for example modified by natural or non-natural phosphorylation, acetylation, or methylation. In the particular application of the present invention, the targets are serum albumin, HGF and VEGF-A.

The term "predetermined property" refers to a property such as binding to a target, blocking of a target, activation of a target-mediated reaction, enzymatic activity, and related further properties. Depending on the type of desired property, one of ordinary skill will be able to identify format and necessary steps for performing screening and/or selection of a binding domain with the desired property. Preferably, said predetermined property is specifically binding to a target.

In the context of the present invention, the term "polypeptide" relates to a molecule consisting of a chain of multiple, i.e. two or more, amino acids linked via peptide bonds.

Preferably, a polypeptide consists of more than eight amino acids linked via peptide bonds. The term "polypeptide" also includes multiple chains of amino acids, linked together by S—S bridges of cysteines. Polypeptides are well-known to the person skilled in the art.

The term "polypeptide tag" refers to an amino acid sequence attached to a polypeptide/protein, wherein said amino acid sequence is useful for the purification, detection, or "targeting" (i.e. localization to the site of a target) of said polypeptide/protein, or wherein said amino acid sequence improves the physicochemical behavior of the polypeptide/protein, or wherein said amino acid sequence possesses an effector function. The individual polypeptide tags of a binding protein may be connected to other parts of the binding protein directly or via polypeptide linkers. These polypeptide tags are all well known in the art and are fully available to the person skilled in the art. Examples of polypeptide tags are small polypeptide sequences, for example, His (e.g. the His-tag of SEQ ID NO: 1), myc, FLAG, or Strep-tags, or polypeptides such as enzymes (for example alkaline phosphatase), which allow the detection of said polypeptide/protein, or polypeptides which can be used for targeting (such as immunoglobulins or fragments thereof) and/or as effector molecules.

The term "polypeptide linker" refers to an amino acid sequence, which is able to link, for example, two protein domains, a polypeptide tag and a protein domain, a protein domain and a non-proteinaceous compound or polymer such as polyethylene glycol, or two sequence tags. Such additional domains, tags, non-proteinaceous compounds or polymers and linkers are known to the person skilled in the relevant art. A list of examples is provided in the description of patent application WO 2002/020565. Particular examples of such linkers are glycine-serine-linkers and proline-threonine-linkers of variable lengths; preferably, said linkers have a length between 2 and 30 amino acids; more preferably, said linkers have a length between 2 and 24 amino acids. Examples of glycine-serine-linkers are GS and amino acid sequences provided in SEQ ID NOs: 2 to 6, and examples of proline-threonine-linkers are provided in amino acid sequences SEQ ID NOs: 7 to 9.

Patent application WO 2002/020565 and Forrer et al., 2003 (loc. cit.), contain a general description of repeat protein features and repeat domain features, techniques and applications. The term "repeat protein" refers to a protein comprising one or more repeat domains. Preferably, a repeat protein comprises up to six repeat domains. More preferably, a repeat protein comprises up to five repeat domains. More preferably, a repeat protein comprises up to four repeat domains. Furthermore, said repeat protein may comprise additional non-repeat protein domains, polypeptide tags and/or polypeptide linkers. The repeat domains can be binding domains as described hereinbefore.

The term "repeat domain" refers to a protein domain comprising two or more consecutive repeat modules as structural units, wherein said structural units have the same fold, and stack tightly to create a superhelical structure having a joint hydrophobic core. Next to a structural homology, such repeat modules further have a sequence homology. Preferably, a repeat domain further comprises an N-terminal and/or a C-terminal capping repeat. For clarity, a capping repeat can be a repeat module. Such repeat domains, repeat modules, and capping repeats, sequence motives, as well as structural homology and sequence homology are well known to the practitioner in the art from examples of designed ankyrin repeat domains (WO 2002/020565), leucine-rich repeat domains (WO 2002/020565), tetratricopeptide repeat domains (Main, E. R., Xiong, Y., Cocco, M. J., D'Andrea, L., Regan, L., Structure 11(5), 497-508, 2003), and armadillo repeat domains (WO 2009/040338). It is further well known to the practitioner in the art, that such repeat domains are different from proteins comprising repeated amino acid sequences, where every repeated amino acid sequence is able to form an individual domain (for example FN3 domains of Fibronectin), or where the repeated amino acid sequences are no structural units, i.e. said repeated amino acid sequences do not stack tightly to create a superhelical structure having a joint hydrophobic core. Methods for identifying and determining repeat modules or repeat sequence motifs or for identifying families of related proteins comprising such repeat units or motifs, such as homology searches (BLAST etc.), are well established in the field of bioinformatics, and are well known to the practitioner in the art.

The term "designed repeat protein" and "designed repeat domain" refer to a repeat protein or repeat domain, respectively, obtained as the result of an inventive procedure, e.g. as explained in patent application WO 2002/020565. The term "designed" refers to the property that such repeat proteins and repeat domains, respectively, are man-made, synthetic and not from nature. The designed repeat proteins or designed repeat domains of WO 2002/020565 include designed ankyrin repeat proteins or designed ankyrin repeat domains, respectively. Accordingly, a designed ankyrin repeat protein herein corresponds to protein of the invention comprising at least one designed ankyrin repeat domain. Further, the term "not from nature" means that the sequence of said binding protein or said binding domain is not present as a non-artificial sequence entry in a sequence database, for example in GenBank, EMBL-Bank or Swiss-Prot. These databases and other similar sequence databases are well known to the person skilled in the art. The recombinant binding proteins or designed ankyrin repeat domains of the invention are non-naturally occurring.

The terms "repeat module", "repeat unit", "capping repeat", "capping module", and further terms relating to repeat proteins and repeat domains, are defined in WO 2002/020565, and the definitions are incorporated by reference.

The term "has binding specificity for a target", "specifically binding to a target", "binding to a target with high specificity", "specific for a target" or "target specificity" and the like means that a binding protein or binding domain binds in PBS to a target with a lower dissociation constant (i.e. it binds with higher affinity) than it binds to an unrelated protein such as the *E. coli* maltose binding protein (MBP). Preferably, the dissociation constant ("Kd") in PBS for the target is at least $10^2$; more preferably, at least $10^3$; more preferably, at least $10^4$; or more preferably, at least $10^5$ times lower than the corresponding dissociation constant for MBP.

Methods to determine dissociation constants of protein-protein interactions, such as surface plasmon resonance (SPR) based technologies (e.g. SPR equilibrium analysis) or isothermal titration calorimetry (ITC) are well known to the person skilled in the art. The measured Kd values of a particular protein-protein interaction can vary if measured under different conditions (e.g., salt concentration, pH). Thus, measurements of Kd values are preferably made with standardized solutions of protein and a standardized buffer, such as PBS.

The term "PBS" means a phosphate buffered water solution containing 137 mM NaCl, 10 mM phosphate and 2.7 mM KCl and having a pH of 7.4.

The term "inhibits the binding" in the context of the binding domains of the present invention refers to the ability of said binding domains to prevent the binding of its target to another protein, typically a natural ligand of the target or another antagonist. The strength of inhibition is typically measured by assessing the concentration of half-maximal inhibition ($IC_{50}$). The term inhibition and the assessment of $IC_{50}$ values are well established in the field. For example, the designed ankyrin repeat domain of SEQ ID NO: 18 inhibits the binding of VEGF-A to its natural ligand VEGFR-2.

The invention relates to designed ankyrin repeat domains with binding specificity for serum albumin, and to recombinant binding proteins comprising at least two designed ankyrin repeat domains with binding specificity for serum albumin, and to recombinant binding proteins comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin.

In one embodiment, the invention relates to designed ankyrin repeat domains with binding specificity for serum albumin. Examples of designed ankyrin repeat domains with binding specificity for serum albumin are given in SEQ ID NOs: 40 to 56 (see also Examples) and further examples are described in WO 2012/069654. In particular, the invention relates to designed ankyrin repeat domains with binding specificity for serum albumin selected from the group of SEQ ID NOs: 48 to 50, more preferably SEQ ID NOs: 49 and 50, more preferably SEQ ID NO: 50, in which up to 10, 9, 8, 7, 6, 5, 4, 3, 2, 1, or 0 amino acids are exchanged by any amino acid. In one embodiment, the invention relates to designed ankyrin repeat domains with binding specificity for serum albumin that have 90%, 91%, 92%, 93%, 94%, 95%, 96%, 97%, 98%, 99% or 100% sequence identity with a designed ankyrin repeat domain selected from the group of SEQ ID NOs: 48 to 50, more preferably SEQ ID NOs: 49 and 50, more preferably SEQ ID NO: 50. In one embodiment, the invention relates to designed ankyrin repeat domains with binding specificity for serum comprising an amino acid sequence selected from the group of SEQ ID NOs: 48 to 50, more preferably SEQ ID NOs: 49 and 50, more preferably SEQ ID NO: 50. In one embodiment, the invention relates to designed ankyrin repeat domains with binding specificity for serum selected that consist of an amino acid sequence selected from the group of SEQ ID NOs: 48 to 50, more preferably SEQ ID NOs: 49 and 50, more preferably SEQ ID NO: 50. In one embodiment, the invention relates to a designed ankyrin repeat domain with binding specificity for serum albumin comprising the amino acid sequence of SEQ ID NO: 50. The preferred designed ankyrin repeat domain with binding specificity for serum albumin of the invention is SEQ ID NO: 50. Preferably, said designed ankyrin repeat domain with binding specificity for serum albumin binds serum albumin of mouse, rat, dog, cynomolgus monkey, or human origin, more preferably serum albumin of mouse, cynomolgus monkey or human origin, more preferably serum albumin of cynomolgus monkey or human origin, more preferably serum albumin of human origin, in PBS with a dissociation constant (Kd) below $10^{-5}$M; preferably below $10^{-6}$M; or more preferably below $10^{-7}$M. The term "mouse serum albumin" refers to UniProt accession number P07724, the term "cynomolgus monkey serum albumin" (i.e. *macaca fascicularis*) refers to UniProt accession number A2V9Z4, and the term "human serum albumin" refers to UniProt accession number P02768. In one embodiment, the invention relates to a designed ankyrin repeat domain with binding specificity for serum albumin comprising, more preferably consisting of, an amino acid sequence selected from the group of SEQ ID NOs: 48 to 50, more preferably SEQ ID NOs: 49 and 50, more preferably SEQ ID NO: 50, which exhibit improved storage stabilities compared to SEQ ID NO: 51. "Improved storage stability" in the context of the present invention means an improved midpoint of denaturation temperature (i.e. midpoint of the cooperative unfolding upon temperature increase) by 0.5° C., 1° C., 1.5° C., 2° C., 2.5° C., 3° C., 3.5° C., or 4° C., and/or the reduction of the amounts of a degradation band, preferably the reduction of the amount of degradation products, as detected by a Coomassie-stained SDS-PAGE occurring after storage at 40° C. for 1 month at 10 mg/ml in PBS, by at least 5%, 10%, 15%, 20%, 25%, 30%, 35%, 40%, 45%, or 50%. Methods to assess storage stability by SDS-PAGE and methods to determine the midpoint of denaturation by using fluorimetric methods or circular dichroism are well known to the person skilled in the art. In one embodiment, the invention relates to a designed ankyrin repeat domain with binding specificity for serum albumin comprising, more preferably consisting of amino acid sequence SEQ ID NO: 50, which exhibits improved storage stability compared to SEQ ID NO: 49, preferably which exhibits reduced amounts of degradation products, as detected by SDS-PAGE, occurring after storage at 40° C. for 1 month at 10 mg/ml in PBS, by at least 5%, 10%, 15%, 20%, 25%, 30%, 35%, 40%, 45%, or 50%, compared to SEQ ID NO: 49. Examples of designed ankyrin repeat domains and recombinant binding proteins with improved storage stability properties are given in Example 9.

In one embodiment, the invention relates to a designed ankyrin repeat domain with binding specificity for serum albumin selected from the group consisting of amino acid sequences SEQ ID NOs: 44 to 49, 51 and 52, more preferably 48, 49, 51, and 52, more preferably 48 and 49, more preferably 49, comprising Glutamate at position 78. In one embodiment, the invention relates to SEQ ID NO: 49 wherein Aspartate at position 78 has been exchanged by Glutamate, corresponding to SEQ ID NO: 50. SEQ ID NO: 49 comprises a high number of potential degradation sites. Degradation may for example occur in the vicinity of any one of the 5 asparagines (including asparagine-glycine dipeptides), 13 aspartates, or 10 glycines of SEQ ID NO: 49, amongst additional potential degradation sites. SEQ ID NO: 49 further comprises a number of potential oxidation sites. Surprisingly, a major effect on storage stability can be achieved by mutating only position 78 of SEQ ID NO: 49. Furthermore, the functionality of the designed ankyrin repeat with binding specificity for serum albumin can be preserved by mutating position 78 of SEQ ID NO: 49 from aspartate to glutamine. The designed ankyrin repeat domain consisting of SEQ ID NO: 49 comprising Glutamate in position 78 exhibits higher storage stability compared to the designed ankyrin repeat domain comprising Aspartate in that position.

In one embodiment, the present invention relates to a recombinant binding protein comprising at least two, preferably comprising two, designed ankyrin repeat domains with binding specificity for serum albumin. The preferred recombinant binding protein of the invention comprises two designed ankyrin repeat domains with binding specificity for serum albumin. Examples of such recombinant binding proteins are given in the amino acid sequences SEQ ID NOs: 62, 63, 73 to 81, and 95 to 179.

In one embodiment, the present invention relates to a recombinant binding protein comprising at least two, more preferably comprising two, designed ankyrin repeat domains with binding specificity for serum albumin, wherein said recombinant binding protein exhibits improved pharmacokinetic properties compared to the recombinant binding protein comprising only one designed ankyrin repeat domain with binding specificity for serum albumin. The examples of the present invention disclose such recombinant binding proteins.

The expression "the recombinant binding protein comprising only one designed ankyrin repeat domain with binding specificity for serum albumin", means a recombinant binding that has the composition of a recombinant binding protein of the present invention in which the number of designed ankyrin repeat domains with binding specificity for serum albumin is reduced to one, by removing all designed ankyrin repeat domains with binding specificity for serum albumin but one, and the corresponding polypeptide linkers. Preferably, said remaining one designed ankyrin repeat domain with binding specificity for serum albumin is located at a position in the recombinant binding protein corresponding to a position that was comprising a designed ankyrin repeat domain with binding specificity for serum albumin in the recombinant binding protein of the present invention, and the remaining one designed ankyrin repeat domain with binding specificity for serum albumin is identical to the designed ankyrin repeat domain with binding specificity for serum albumin that was at the corresponding position in the recombinant binding protein of the present invention. For example, the recombinant binding protein consisting of SEQ ID NO: 85 is the recombinant binding protein consisting of SEQ ID NO: 95, in which the C-terminal designed ankyrin repeat domain with binding specificity for serum albumin (in this case SEQ ID NO: 50) as well as the adjacent polypeptide linker (in this case SEQ ID NO: 9) have been removed. Importantly, the remaining designed ankyrin repeat domain with binding specificity for serum albumin (SEQ ID NO: 50) of SEQ ID NO: 85 is N-terminal, and SEQ ID NO: 95 comprises the same SEQ ID NO: 50 at the same position. Likewise, the recombinant binding protein consisting of SEQ ID NO: 83 is the recombinant binding protein consisting of SEQ ID NO: 110, in which the C-terminal designed ankyrin repeat domain with binding specificity for serum albumin (in this case SEQ ID NO: 50) as well as the adjacent polypeptide linker (in this case SEQ ID NO: 9) have been removed.

The expression "exhibits improved pharmacokinetic properties", "improved pharmacokinetic properties", or "pharmacokinetic property improvement" in this invention has the meaning that a pharmacokinetic parameter of a recombinant binding protein is improved compared to the corresponding pharmacokinetic parameter of a protein it is compared with. Corresponding examples are shown in Examples 5 and 6 and FIGS. 3A-3D and FIGS. 4A-4B. For example, when comparing Protein #110 (a protein consisting of SEQ ID NO: 110 and additionally SEQ ID NO: 1 at the N terminus) with Protein #83 (a protein consisting of SEQ ID NO: 83 and additionally SEQ ID NO: 1 at the N terminus) in cynomolgus monkey pharmacokinetic studies Protein #110 has a higher exposure (+32%), a reduced clearance (−47%) as well as a higher terminal half-life (+168%, calculated from day 1 to day 6) as Protein #83. As another example, when comparing Protein #62 (a protein consisting of SEQ ID NO: 62 and additionally SEQ ID NO: 1 at the N terminus) with Protein #57 (a protein consisting of SEQ ID NO: 57 and additionally SEQ ID NO: 1 at the N terminus) in cynomolgus monkey pharmacokinetic studies Protein #62 has a higher exposure (+119%), a reduced clearance (−71%) as well as a higher terminal half-life (+97%, calculated from day 1 to day 7) as Protein #57. Or when comparing Protein #109 (a protein consisting of SEQ ID NO: 109 and additionally SEQ ID NO: 1 at the N terminus) with Protein #82 (a protein consisting of SEQ ID NO: 82 and additionally SEQ ID NO: 1 at the N terminus) in cynomolgus monkey pharmacokinetic studies Protein #109 has a higher exposure (+19%), a reduced clearance (−37%) as well as a higher terminal half-life (+55%, calculated from day 1 to day 7) as Protein #82. As yet another example, when comparing Protein #97 (a protein consisting of SEQ ID NO: 97 and additionally SEQ ID NO: 1 at the N terminus) with Protein #68 (a protein consisting of SEQ ID NO: 68 and additionally SEQ ID NO: 1 at the N terminus) in cynomolgus monkey pharmacokinetic studies Protein #97 has a higher terminal half-life (+264%, calculated from day 1 to day 7) as Protein #68. Further examples are given in Examples 5 and 6 as well as FIGS. 3A-3D and FIGS. 4A-4B. Preferably, an improved pharmacokinetic property is a reduced clearance, and/or an increased exposure, and/or an increased terminal half-life. More preferably, an improved pharmacokinetic property is an increased terminal half-life. In one embodiment, a recombinant binding protein of the present invention, comprising at least two, more preferably comprising two, designed ankyrin repeat domains with binding specificity for serum albumin exhibits an increased terminal half-life, and/or a reduced clearance, and/or an increased exposure of at least 5%, 10%, 15%, 20%, 25%, 30%, 35%, 40%, 45%, 50%, 60%, 70%, 80%, 90%, 100%, 150%, 200%, or 250% compared to the recombinant binding protein comprising only one designed ankyrin repeat domain with binding specificity for serum albumin. In one embodiment, a recombinant binding protein of the present invention, comprising at least two, more preferably comprising two, designed ankyrin repeat domains with binding specificity for serum albumin exhibits an increased terminal half-life, preferably an increased terminal half-life of at least 5%, 10%, 15%, 20%, 25%, 30%, 35%, 40%, 45%, 50%, 60%, 70%, 80%, 90%, 100%, 150%, 200%, or 250% compared to the recombinant binding protein comprising only one designed ankyrin repeat domain with binding specificity for serum albumin.

Preferably, clearance, and/or exposure, and/or terminal half-life are assessed in a mammal, more preferably mouse and/or cynomolgus monkey, more preferably cynomolgus monkey. Preferably, when measuring the clearance, and/or exposure, and/or terminal half-life in mouse, the evaluation is done considering the data up to 48 h post-injection. More preferably, the evaluation of terminal half-life in mouse is calculated from 24 h to 48 h. Preferably, when measuring the clearance, and/or exposure, and/or terminal half-life in cynomolgus monkey, the evaluation is done considering the data up to day 7 post-injection. More preferably, the evaluation of terminal half-life in cynomolgus monkey is calculated from day 1 to day 7. The term "terminal half-life" of a drug such as a recombinant binding protein of the invention refers to the time required to reach half the plasma concentration of the drug applied to a mammal after reaching pseudo-equilibrium (for example calculated from 24 h to 48 h in mouse or calculated from day 1 to day 7 in cynomolgus monkey). Terminal half-life is not defined as the time required to eliminate half the dose of the drug administered to the mammal. The term terminal half-life is well known to the person skilled in the art. Preferably, pharmacokinetic comparison is done at any dose, more preferably at equivalent dose (i.e. same mg/kg dose) or equimolar dose (i.e. same mol/kg dose), more preferably at equimolar dose (i.e. same mol/kg dose). It is understood by the person skilled in the art that equivalent and/or equimolar dosing in animals is subject to experimental dose variations of at least 20%, more preferably 30%, 40%, 50%, 60%, 70%, 80%, 90%, or 100%. Preferably, a dose used for pharmacokinetic measurement is selected from 0.001 to 1000 mg/kg, more preferably 0.01 to 100 mg/kg, more preferably 0.1 to 50 mg/kg, more preferably 0.5 to 10 mg/kg.

In one embodiment, a recombinant binding protein of the present invention comprising at least two, more preferably comprising two, designed ankyrin repeat domains with binding specificity for serum albumin, exhibits a higher percentage of injected dose in mouse 24 h and/or 48 h and/or 72 h post injection, preferably 24 h post-injection, preferably 48 h post-injection, more preferably 72 h post-injection, more preferably 72 h and 48 h post-injection, more preferably 24 h, 48 h and 72 h post-injection, compared to the recombinant binding protein comprising only one designed ankyrin repeat domain with binding specificity for serum albumin. Preferably, the percentage of injected dose in mouse is calculated by comparison to the concentration measurement 1 h or 4 h, preferably 1 post-injection. In one embodiment, the recombinant binding protein of the present invention comprising at least two, more preferably comprising two, designed ankyrin repeat domains with binding specificity for serum albumin, exhibits a higher percentage of injected dose in cynomolgus monkey 4 days and/or 5 days and/or 6 days post-injection, preferably 4 days, preferably 5 days, more preferably 6 days, more preferably 5 and 6 days post-injection, more preferably 4, 5, and 6 days post-injection, compared to the recombinant binding protein comprising only one designed ankyrin repeat domain with binding specificity for serum albumin. Preferably, the percentage of injected dose in cynomolgus monkey is calculated by comparison to the concentration measurement 10 min or 1 h, preferably 10 min post-injection. A higher percentage of injected dose refers to an increased percentage of dose of at least 5%, 10%, 15%, 20%, 25%, 30%, 35%, 40%, 45%, 50%, 60%, 70%, 80%, 90%, 100%, 150%, 200%, or 250%.

In one embodiment, the recombinant binding protein of the present invention comprises at least three designed ankyrin repeat domains, wherein at least two designed ankyrin repeat domains are designed ankyrin repeat domains with binding specificity for serum albumin. Examples of such recombinant binding proteins are given in the amino acid sequences SEQ ID NOs: 73 to 81 and 95 to 179.

In one embodiment, the recombinant binding protein comprises at least four designed ankyrin repeat domains, wherein at least two designed ankyrin repeat domains are designed ankyrin repeat domains with binding specificity for serum albumin. Examples of such recombinant binding proteins are given in the amino acid sequences SEQ ID NOs: 95 to 179.

In one embodiment, the invention relates to a recombinant binding protein comprising at least two designed ankyrin repeat domains with binding specificity for serum albumin, wherein each of said designed ankyrin repeat domains with binding specificity for serum albumin in PBS has binding specificity for serum albumin of mammalian origin, more preferably mouse, rat, dog, cynomolgus monkey, or human origin, more preferably serum albumin of mouse, cynomolgus monkey or human origin, more preferably serum albumin of cynomolgus monkey or human origin, more preferably serum albumin of human origin.

In one embodiment, the invention relates to a recombinant binding protein comprising at least two designed ankyrin repeat domains with binding specificity for serum albumin, wherein each of said designed ankyrin repeat domains with binding specificity for serum albumin binds serum albumin, more preferably serum albumin of mammalian origin, more preferably serum albumin of mouse, rat, dog, cynomolgus monkey, or human origin, more preferably serum albumin of mouse, cynomolgus monkey or human origin, more preferably serum albumin of cynomolgus monkey or human origin, preferably serum albumin of human origin, in PBS with a dissociation constant (Kd) below $10^{-5}$M, preferably below $10^{-6}$M, more preferably below $10^{-7}$M. Examples of such designed ankyrin repeat domains with binding specificity for serum albumin are given in Example 2 and in SEQ ID NOs: 40 to 56.

In one embodiment, the present invention relates to a recombinant binding protein comprising two designed ankyrin repeat domains with binding specificity for serum albumin, wherein said two designed ankyrin repeat domains with binding specificity for serum albumin are at any position compared to any other protein domain, preferably any other designed ankyrin repeat domain, comprised in said recombinant binding protein, preferably wherein said two designed ankyrin repeat domains with binding specificity for serum albumin are both N-terminal of any other protein domain, preferably any other designed ankyrin repeat domain, comprised in said recombinant binding protein, or wherein said two designed ankyrin repeat domains with binding specificity for serum albumin are one N-terminal and one C-terminal of any other protein domain, preferably any other designed ankyrin repeat domain, comprised in said recombinant binding protein, or, more preferably, wherein said two designed ankyrin repeat domains with binding specificity for serum albumin are one N-terminal and one C-terminal of any other protein domain, preferably any other designed ankyrin repeat domain, comprised in said recombinant binding protein. Preferably, said two designed ankyrin repeat domains with binding specificity for serum albumin are not both C-terminal of any other protein domain, preferably any other designed ankyrin repeat domain, comprised in said recombinant binding protein. Examples of different arrangements of designed ankyrin repeat domains within a recombinant binding protein are given in SEQ ID NOs: 95 to 179, and are described in the Examples. SEQ ID NOs: 134 illustrates the preferred arrangement of the two designed ankyrin repeat domains with binding specificity for serum albumin in a recombinant binding protein of the present invention.

In one embodiment, the invention relates to a recombinant binding protein comprising at least three, preferably comprising at least four, more preferably comprising four designed ankyrin repeat domains, wherein two of said at least three, preferably at least four, more preferably four designed ankyrin repeat domains each have binding specificity for serum albumin, and/or, preferably and wherein said at least three, preferably at least four, more preferably four designed ankyrin repeat domains are linked by polypeptide linkers.

In one embodiment, the invention relates to a recombinant binding protein comprising at least two designed ankyrin repeat domains with binding specificity for serum albumin, wherein said designed ankyrin repeat domains with binding specificity for serum albumin each have at least 90%, 91%, 92%, 93%, 94%, 95%, 98%, 97%, 98%, 99% or 100% identity with any amino acid sequence selected from the group of SEQ ID NOs: 44 to 52, preferably SEQ ID NOs: 48 to 50, more preferably SEQ ID NOs: 49 and 50, more preferably SEQ ID NO: 50.

In one embodiment, the invention relates to a recombinant binding protein comprising at least two designed ankyrin repeat domains with binding specificity for serum albumin, wherein said designed ankyrin repeat domains with binding specificity for serum albumin are selected from any amino acid sequence selected from the group of SEQ ID NOs: 44 to 52, preferably SEQ ID NOs: 48 to 50, more preferably SEQ ID NOs: 49 and 50, more preferably SEQ ID NO: 50, and wherein in each of said two designed ankyrin repeat domains with binding specificity for serum albumin up to 10, 9, 8, 7, 6, 5, 4, 3, 2, 1 or 0 amino acids are exchanged by any amino acid.

In one embodiment, the invention relates to a recombinant binding protein comprising at least two designed ankyrin repeat domains with binding specificity for serum albumin, wherein said designed ankyrin repeat domains with binding specificity for serum albumin are selected from any amino acid sequence selected from the group of SEQ ID NOs: 44 to 52, preferably SEQ ID NOs: 48 to 50, more preferably SEQ ID NOs: 49 and 50, more preferably SEQ ID NO: 50. In one embodiment, the invention relates to a recombinant binding protein comprising at least two designed ankyrin repeat domains with binding specificity for serum albumin, wherein said designed ankyrin repeat domains with binding specificity for serum albumin each comprise the amino acid sequence of SEQ ID NO: 50.

In one embodiment, the invention relates to a recombinant binding protein comprising at least two designed ankyrin repeat domains with binding specificity for serum albumin, wherein said designed ankyrin repeat domains with binding specificity for serum albumin are at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical in amino acid sequence. In one embodiment, said designed ankyrin repeat domains with binding specificity for serum albumin of said recombinant binding protein are identical in amino acid sequence. For example, the two designed ankyrin repeat domains with binding specificity for serum albumin comprised in SEQ ID NO: 130 are at least 95% identical (6 residues difference on 124 amino acids). In another example, the two designed ankyrin repeat domains with binding specificity for serum albumin comprised in SEQ ID NO: 129 are at least 80% identical (24 residues difference on 124 amino acids).

In one embodiment, the invention relates to a recombinant binding protein comprising at least two designed ankyrin repeat domains with binding specificity for serum albumin, wherein the designed ankyrin repeat domains with binding specificity for serum albumin are able to simultaneously bind one serum albumin molecule each. Preferably, said serum albumin is of human origin. Examples for simultaneous binding of two human serum albumin molecules by recombinant binding proteins of the present invention, comprising two designed ankyrin repeat domains with binding specificity for serum albumin, are shown in Example 7.

In one embodiment, the invention relates to a recombinant binding protein comprising at least 3, 4, 5, 6, 7, 8, 9, 10 designed ankyrin repeat domains with binding specificity for serum albumin.

In one embodiment, the invention relates to a recombinant binding protein comprising at least three, preferably at least four, more preferably comprising four, designed ankyrin repeat domains, wherein at least two, more preferably two, of said designed ankyrin repeat domains are designed ankyrin repeat domains with binding specificity for serum albumin, more preferably human serum albumin, and wherein said at least two, more preferably two, designed ankyrin repeat domains with binding specificity for serum albumin are at least, preferably are, one N-terminal and one C-terminal of any other designed ankyrin repeat domain, preferably the other two designed ankyrin repeat domains, and wherein said at least two, more preferably two, designed ankyrin repeat domains with binding specificity for serum albumin are each binding serum albumin, preferably serum albumin of human origin, in PBS with a dissociation constant (Kd) of at least $10^{-5}$M, preferably below $10^{-6}$M, or more preferably below $10^{-7}$M, and wherein said recombinant binding protein exhibits an increased terminal half-life, preferably an increased terminal half-life of at least 5%, 10%, 15%, 20%, 25%, 30%, 35%, 40%, 45%, or 50% compared to the recombinant binding protein comprising only one designed ankyrin repeat domain with binding specificity for serum albumin, and wherein said at least three, preferably at least four, more preferably four, designed ankyrin repeat domains are linked by polypeptide linkers. In one embodiment, said at least two, more preferably two, designed ankyrin repeat domains with binding specificity for serum albumin of said recombinant binding protein are at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, more preferably identical.

In one embodiment, protein domains or the designed ankyrin repeat domains present in a recombinant binding protein of the present invention are linked by polypeptide linkers of any amino acid sequence composition. In one embodiment, the polypeptide linkers linking protein domains or the designed ankyrin repeat domains present in a recombinant binding protein of the present invention comprise amino acid sequences selected from the group consisting of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9, in which up to 4, 3, 2, 1, 0 amino acids are exchanged by any amino acid. In one embodiment, said polypeptide linkers comprise an amino acid sequence chosen from any of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9. In one embodiment, the flanking N-terminal Gly Ser of SEQ ID NOs: 7 to 9 and/or the flanking C-terminal Gly Ser of SEQ ID NOs: 2 to 9 are optionally missing. In one embodiment, SEQ ID NOs: 7 to 9 additionally comprises Arg Ser C-terminally (as e.g. present in SEQ ID NOs: 68 and 109). In one embodiment, the second-to-C-terminal amino acid glycine of said polypeptide linkers of SEQ ID NOs: 2 to 6 may be exchanged by arginine (as e.g. present in SEQ ID NOs: 70 and 88). In one embodiment, the polypeptide linkers linking the designed ankyrin repeat domains present in a recombinant binding protein of the present invention consist of an amino acid sequence selected from of any of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9. In one embodiment, said polypeptide linkers present in a recombinant binding protein of the present invention are 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, preferably identical.

In one embodiment, the invention relates to a recombinant binding protein comprising at least two designed ankyrin repeat domains with binding specificity for serum albumin, wherein said polypeptide linkers comprise amino acid sequences selected from the group consisting of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9, in which up to 4, 3, 2, 1, 0 amino acids are exchanged by any amino acid, and wherein said designed ankyrin repeat domains with binding specificity for serum albumin each have at least 90%, 91%, 92%, 93%, 94%, 95%, 96%, 97%, 98%, 99%, 100% identity with any amino acid sequence selected from the group of SEQ ID NOs: 44 to 52, preferably SEQ ID NOs: 48 to 50, more preferably SEQ ID NOs: 49 and 50, more preferably SEQ ID NO: 50.

In one embodiment, the invention relates to a recombinant binding protein comprising at least two designed ankyrin repeat domains with binding specificity for serum albumin, wherein said polypeptide linkers consist of an amino acid sequences selected from the amino acid sequences SEQ ID NOs: 6 or 9, in which up to 4, 3, 2, 1, 0 amino acids are exchanged by any amino acid, and wherein said designed ankyrin repeat domains with binding specificity for serum albumin each consist of an amino acid sequence that has at least 90%, 91%, 92%, 93%, 94%, 95%, 96%, 97%, 98%, 99%, 100% identity with any amino acid sequence selected from the group of SEQ ID NOs: 48 to 50.

In one embodiment, the invention relates to a recombinant binding protein comprising at least two designed ankyrin repeat domains with binding specificity for serum albumin, wherein said at least two designed ankyrin repeat domains with binding specificity for serum albumin each comprise the amino acid sequence of SEQ ID NO: 50.

In one embodiment, the invention relates to a recombinant binding protein comprising at least two designed ankyrin repeat domains with binding specificity for serum albumin, wherein said at least two designed ankyrin repeat domains with binding specificity for serum albumin each comprise the amino acid sequence of SEQ ID NO: 50, and wherein said recombinant binding protein exhibits improved storage stability, preferably reduced amounts of degradation products after storage at 40° C. for 1 month at 10 mg/ml in PBS, compared to the recombinant binding protein, wherein said at least two designed ankyrin repeat domains with binding specificity for serum albumin each comprise the amino acid sequence of SEQ ID NO: 49, and/or compared to the recombinant binding protein, wherein said at least two designed ankyrin repeat domains with binding specificity for serum albumin each comprise the amino acid sequence of SEQ ID NO: 51, preferably compared to the recombinant binding protein, wherein said at least two designed ankyrin repeat domains with binding specificity for serum albumin each comprise the amino acid sequence of SEQ ID NO: 49.

In one embodiment, the invention relates to a recombinant binding protein comprising at least two designed ankyrin repeat domains with binding specificity for serum albumin, wherein said at least two designed ankyrin repeat domains with binding specificity for serum albumin each comprise the amino acid sequence of SEQ ID NO: 50, and wherein said designed ankyrin repeat domains are linked by polypeptide linkers each comprising the amino acid sequence of SEQ ID NO: 9.

In one embodiment, the invention relates to a recombinant binding protein comprising at least two designed ankyrin repeat domains with binding specificity for serum albumin, wherein said at least two designed ankyrin repeat domains with binding specificity for serum albumin each consist of the amino acid sequence of SEQ ID NO: 50.

In one embodiment, the invention relates to a recombinant binding protein comprising at least two designed ankyrin repeat domains with binding specificity for serum albumin, wherein said at least two designed ankyrin repeat domains with binding specificity for serum albumin each consist of the amino acid sequence of SEQ ID NO: 50, and wherein said designed ankyrin repeat domains are linked by polypeptide linkers each consisting of the amino acid sequence of SEQ ID NO: 9.

In one embodiment the invention relates to a recombinant binding protein comprising four designed ankyrin repeat domains, wherein two of said designed ankyrin repeat domains are designed ankyrin repeat domains with binding specificity for serum albumin, wherein said two designed ankyrin repeat domains with binding specificity for serum albumin each comprise the amino acid sequence of SEQ ID NO: 50, and wherein said designed ankyrin repeat domains are linked by polypeptide linkers each comprising the amino acid sequence of SEQ ID NO: 9, and wherein said designed ankyrin repeat domains are arranged (from N-terminal side to C-terminal side): SEQ ID NO: 50-SEQ ID NO: 9-XXX-SEQ ID NO: 9-YYY-SEQ ID NO: 9-SEQ ID NO: 50, wherein XXX and YYY each represent a designed ankyrin repeat domain with binding specificity for another target than serum albumin.

In one embodiment, the present invention relates to a recombinant binding protein comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin. Preferably, said recombinant binding protein consists of a single polypeptide chain. More preferably, said first, second, third and fourth designed ankyrin repeat domain are linked by polypeptide linkers. In one embodiment, the present invention relates to a recombinant binding protein comprising a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin. Examples of such recombinant binding proteins are given in amino acid sequences SEQ ID NOs: 95 to 108 and 116 to 179.

Preferably, the designed ankyrin repeat domain with binding specificity for VEGF-A binds VEGF-A of mouse, rat, dog, rabbit, cynomolgus monkey, or human origin, more preferably VEGF-A of mouse, cynomolgus monkey or human origin, more preferably VEGF-A of cynomolgus monkey or human origin, more preferably VEGF-A of human origin. Preferably, VEGF-A is human VEGF-A165. Examples of designed ankyrin repeat domains with binding specificity to VEGF-A are given herein (SEQ ID NOs: 12 to 21; see examples) and further examples are described in WO 2010/060748 and WO 2011/135067.

Preferably, the designed ankyrin repeat domain with binding specificity for HGF binds HGF of mouse, rat, dog, rabbit, cynomolgus monkey, or human origin, more preferably HGF of mouse, cynomolgus monkey or human origin, more preferably HGF of cynomolgus monkey or human origin, more preferably HGF of human origin. Examples of designed ankyrin repeat domains with binding specificity to HGF are given herein (SEQ ID NOs: 23 to 37; see examples) and further examples are described in WO 2014/191574.

In one embodiment the recombinant binding protein or designed ankyrin repeat domain is devoid of a free Cys residue. A "free Cys residue" is not involved in the formation of a disulfide bond. In one embodiment, the invention relates to a binding protein or binding domain free of any Cys residue. In one embodiment, the designed ankyrin repeat domain and/or recombinant binding protein devoid of any disulfide bond. The disulfide bonds of antibody fragments for example are known to the person skilled in the art to hamper the simple production of the antibody fragments in bacteria.

The techniques to modify a recombinant binding protein of the present invention are well known to the person skilled in the art.

In particular, the invention relates to a recombinant binding protein comprising at least a first, a second, a third, and a fourth designed ankyrin repeat domain, wherein said first designed ankyrin repeat domain binds VEGF-A in PBS with a dissociation constant (Kd) below $10^{-7}$M; preferably below $10^{-8}$M; more preferably below $10^{-9}$M; or more preferably below $10^{-10}$M; and wherein said second designed ankyrin repeat domain binds HGF in PBS with a Kd below $10^{-7}$M; preferably below $10^{-8}$M; more preferably below $10^{-9}$M; or more preferably below $10^{-10}$M; and wherein said third and fourth designed ankyrin repeat domains each bind serum albumin in PBS with a Kd below $10^{-5}$M; preferably below $10^{-6}$M; or more preferably below $10^{-7}$M. Examples of designed ankyrin repeat domains with binding specificity to VEGF-A, designed ankyrin repeat domains with binding specificity to HGF, and designed ankyrin repeat domains with binding specificity to serum albumin are given herein (SEQ ID NOs: 12 to 56; see examples).

Furthermore, the invention relates to a recombinant binding protein comprising at least a first, a second, a third, and a fourth designed ankyrin repeat domain, wherein said first designed ankyrin repeat domain inhibits the binding of human VEGF-A to human VEGFR-2 in PBS with an $IC_{50}$ value below $10^{-7}$M, preferably $10^{-8}$M, more preferably $10^{-9}$M, and wherein said second designed ankyrin repeat domain inhibits the binding of human HGF to human cMet in PBS with an $IC_{50}$ value below $10^{-7}$M, preferably $10^{-8}$M, more preferably $10^{-9}$M. Different examples of designed ankyrin repeat domains selected from SEQ ID NOs: 12 to 37 are given in the examples.

In one embodiment, the invention relates to a recombinant binding protein comprising at least a first, a second, a third, and a fourth designed ankyrin repeat domain, wherein said first designed ankyrin repeat domain comprises an amino acid sequence that has at least 90%, 91%, 92%, 93%, 94%, 95%, 96%, 97%, 98%, 99%, 100% amino acid sequence identity with one designed ankyrin repeat domain selected from the group consisting of amino acid sequences SEQ ID NOs: 12 to 21, more preferably SEQ ID NOs: 17 to 21, more preferably SEQ ID NOs: 18 to 20, more preferably SEQ ID NO: 18. In one embodiment, said first designed ankyrin repeat domain comprises an amino acid sequence selected from the group consisting of amino acid sequences SEQ ID NOs: 12 to 21, more preferably SEQ ID NOs: 17 to 21, more preferably SEQ ID NOs: 18 to 20, more preferably SEQ ID NO: 18, and amino acid sequences in which up to 10, 9, 8, 7, 6, 5, 4, 3, 2, 1, 0 amino acids of SEQ ID NOs: 12 to 21, more preferably SEQ ID NOs: 17 to 21, more preferably SEQ ID NOs: 18 to 20, more preferably SEQ ID NO: 18, are exchanged by any amino acid. In one embodiment, said first designed ankyrin repeat domain comprises an amino acid sequence selected from the group consisting of amino acid sequences SEQ ID NOs: 14 to 21, in which individual amino acids are replaced by any amino acid occurring at the same position of an alignment of the amino acid sequences of SEQ ID NOs: 14 to 21. In one embodiment, said first designed ankyrin repeat domain comprises an amino acid sequence selected from the group consisting of amino acid sequences SEQ ID NOs: 12 to 21, more preferably SEQ ID NOs: 17 to 21, more preferably SEQ ID NOs: 18 to 20, more preferably SEQ ID NO: 18. In one embodiment, said first designed ankyrin repeat domain consists of an amino acid sequence selected from the group consisting of amino acid sequences SEQ ID NOs: 12 to 21, more preferably SEQ ID NOs: 17 to 21, more preferably SEQ ID NOs: 18 to 20, more preferably SEQ ID NO: 18. Furthermore, said second designed ankyrin repeat domain of said recombinant binding protein preferably comprises an amino acid sequence that has at least 90%, 91%, 92%, 93%, 94%, 95%, 96%, 97%, 98%, 99%, 100% amino acid sequence identity with one designed ankyrin repeat domain selected from the group consisting of amino acid sequences SEQ ID NOs: 23 to 37, more preferably SEQ ID NOs: 23 to 27, more preferably SEQ ID NOs: 25 to 27, more preferably SEQ ID NO: 26. In one embodiment, said second designed ankyrin repeat domain comprises an amino acid sequence selected from the group consisting of amino acid sequences SEQ ID NOs: 23 to 37, more preferably SEQ ID NOs: 23 to 27, more preferably SEQ ID NOs: 25 to 27, more preferably SEQ ID NO: 26, and amino acid sequences in which up to 10, 9, 8, 7, 6, 5, 4, 3, 2, 1, 0 amino acids of SEQ ID NOs: 23 to 37, more preferably SEQ ID NOs: 23 to 27, more preferably SEQ ID NOs: 25 to 27, more preferably SEQ ID NO: 26, are exchanged by any amino acid. In one embodiment, said second designed ankyrin repeat domain comprises an amino acid sequence selected from the group consisting of amino acid sequences SEQ ID NOs: 23 to 27, in which individual amino acids are replaced by any amino acid occurring at the same position of an alignment of the amino acid sequences of SEQ ID NOs: 23 to 27. In one embodiment, said second designed ankyrin repeat domain comprises an amino acid sequence selected from the group consisting of amino acid sequences SEQ ID NOs: 23 to 37, more preferably SEQ ID NOs: 23 to 27, more preferably SEQ ID NOs: 25 to 27, more preferably SEQ ID NO: 26. In one embodiment, said second designed ankyrin repeat domain consists of an amino acid sequence selected from the group consisting of amino acid sequences SEQ ID NOs: 23 to 37, more preferably SEQ ID NOs: 23 to 27, more preferably SEQ ID NOs: 25 to 27, more preferably SEQ ID NO: 26. In one embodiment, said third and fourth designed ankyrin repeat domains of said recombinant binding protein each comprise an amino acid sequence that has at least 90%, 91%, 92%, 93%, 94%, 95%, 98%, 97%, 98%, 99%, 100% amino acid sequence identity with one ankyrin repeat domain selected from the group consisting of amino acid sequences SEQ ID NOs: 40 to 56, preferably SEQ ID NOs: 48 to 52, more preferably SEQ ID NOs: 48 to 50, more preferably SEQ ID NO: 50. In one embodiment, said third and fourth designed ankyrin repeat domains each comprise an amino acid sequence selected from the group consisting of amino acid sequences SEQ ID NOs: 40 to 56, preferably SEQ ID NOs: 48 to 52, more preferably SEQ ID NOs: 48 to 50, more preferably SEQ ID NO: 50, and amino acid sequences in which up to 10, 9, 8, 7, 6, 5, 4, 3, 2, 1, 0 amino acids of SEQ ID NOs: 40 to 56, preferably SEQ ID NOs: 48 to 52, more preferably SEQ ID NOs: 48 to 50, more preferably SEQ ID NO: 50, are exchanged by any other amino acid. In one embodiment, said third and fourth designed ankyrin repeat domains each comprise an amino acid sequence selected from the group consisting of amino acid sequences SEQ ID NOs: 42 to 51, in which individual amino acids are replaced by any amino acid occurring at the same position of an alignment of the amino acid sequences of SEQ ID NOs: 42 to 51. In one embodiment, said third and fourth designed ankyrin repeat domains each comprise an amino acid sequence selected from the group consisting of amino acid sequences SEQ ID NOs: 40 to 56, preferably SEQ ID NOs: 48 to 52, more preferably SEQ ID NOs: 48 to 50, more preferably SEQ ID NO: 50. In one embodiment, said third and fourth designed ankyrin repeat domains each consist of an amino acid sequence selected from the group consisting of amino acid sequences SEQ ID NOs: 40 to 56, preferably SEQ ID NOs: 48 to 52, more preferably SEQ ID NOs: 48 to 50, more preferably SEQ ID NO: 50. In one embodiment, said third and fourth designed ankyrin repeat domains are identical. Further in this embodiment, said designed ankyrin repeat domains are linked by polypeptide linkers selected from the group consisting of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9, and amino acid sequences in which up to 4, 3, 2, 1, 0 amino acids of SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9, are exchanged by any amino acid. In one embodiment, said polypeptide linkers comprise an amino acid sequence selected from the group consisting of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9. In one embodiment, the flanking N-terminal Gly Ser of SEQ ID NOs: 7 to 9 and/or the flanking C-terminal Gly Ser of SEQ ID NOs: 2 to 9 are optionally missing. In one embodiment, SEQ ID NOs: 7 to 9 additionally comprises Arg Ser C-terminally (as e.g. present in SEQ ID NOs: 97 and 98). In one embodiment, the second-to-C-terminal amino acid glycine of said polypeptide linkers of SEQ ID NOs: 2 to 6 may be exchanged by arginine (as e.g. present in SEQ ID NOs: 99 and 100). In one embodiment, the polypeptide linkers linking the designed ankyrin repeat domains present in a recombinant binding protein of the present invention consist of an amino acid sequence selected from of any of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9. In one embodiment, said polypeptide linkers present in a recombinant binding protein of the present invention are identical. Examples of such polypeptide linkers, variations thereof, and the use of such polypeptide linkers in recombinant binding proteins are given in the examples.

In one embodiment, the invention relates to a recombinant binding protein comprising at least a first, a second, a third, and a fourth designed ankyrin repeat domain, wherein said first designed ankyrin repeat domain comprises an amino acid sequence selected from the group consisting of amino acid sequences SEQ ID NOs: 12 to 21, preferably SEQ ID NOs: 17 to 21, more preferably SEQ ID NOs: 18 to 20, more preferably SEQ ID NO: 18, and wherein said second designed ankyrin repeat domain comprises an amino acid sequence selected from the group consisting of amino acid sequences SEQ ID NOs: 23 to 37, more preferably SEQ ID NOs: 23 to 27, more preferably SEQ ID NOs: 25 to 27, more preferably SEQ ID NO: 26, and wherein said third and fourth designed ankyrin repeat domains each comprise an amino acid sequence selected from the group consisting of amino acid sequences SEQ ID NOs: 40 to 56, preferably SEQ ID NOs: 48 to 52, more preferably SEQ ID NOs: 48 to 50, more preferably SEQ ID NO: 50, and wherein said designed ankyrin repeat domains are linked by polypeptide linkers selected from the group consisting of amino acid sequences SEQ ID NOs: 2 to 9, more preferably SEQ ID NOs: 3 to 9, more preferably SEQ ID NOs: 4 to 9, more preferably SEQ ID NOs: 6 or 9, more preferably SEQ ID NO: 9.

In one embodiment, the invention relates to a recombinant binding protein comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin, and wherein said designed ankyrin repeat domains are linked by polypeptide linkers, and wherein said recombinant binding protein can bind VEGF-A and HGF, more preferably VEGF-A, HGF, and serum albumin, more preferably human VEGF-A, human HGF and human serum albumin, simultaneously. In one embodiment, said recombinant binding protein can bind two serum albumin molecules, more preferably two human serum albumin molecules, simultaneously.

The terms "first, "second", "third", and optionally "fourth", used in "first designed ankyrin repeat domain", "second designed ankyrin repeat domain", "third designed ankyrin repeat domain", and "fourth designed ankyrin repeat domain", do not indicate or imply any positional arrangement of said designed ankyrin repeat domains within the recombinant binding protein.

In one embodiment, the invention relates to a recombinant binding protein comprising at least a first, a second, a third, and a fourth designed ankyrin repeat domain which are linked by polypeptide linkers. In one embodiment, said first designed ankyrin repeat domain is N-terminal of the C-terminal designed ankyrin repeat domain and C-terminal of the other two designed ankyrin repeat domains. In one embodiment, said second designed ankyrin repeat domain, having a binding specificity for HGF, is C-terminal of the N-terminal designed ankyrin repeat domain and N-terminal of the other two designed ankyrin repeat domains. In one embodiment, said third and fourth designed ankyrin repeat domains, each having a binding specificity for serum albumin, are one N-terminal and one C-terminal of the other two designed ankyrin repeat domains, or they are N-terminal of the other two designed ankyrin repeat domains, more preferably said third and fourth designed ankyrin repeat domains are one N-terminal and one C-terminal of the other two designed ankyrin repeat domains. In one embodiment, said third designed ankyrin repeat domain is N-terminal of the other three designed ankyrin repeat domains, said fourth designed ankyrin repeat domain is C-terminal of the other three designed ankyrin repeat domains, said second designed ankyrin repeat domain is C-terminal of said third designed ankyrin repeat domain and N-terminal of said first designed ankyrin repeat domain, and said first designed ankyrin repeat domain is C-terminal of said second designed ankyrin repeat domain and N-terminal of said fourth designed ankyrin repeat domain.

In one embodiment, the invention relates to a recombinant binding protein comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin, and wherein said designed ankyrin repeat domains are linked by polypeptide linkers. In one embodiment, said first, second, third and fourth designed ankyrin repeat domains are in the order (from N terminus to C terminus) third-second-first-fourth, third-fourth-second-first, fourth-second-first-third, or fourth-third-second-first, even more preferably third-second-first-fourth, or fourth-second-first-third, more preferably third-second-first-fourth.

In one embodiment, the invention relates to a recombinant binding protein comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin, wherein said recombinant binding protein binds VEGF-A, preferably human VEGF-A, with an $EC_{50}$ of less than $10^{-7}$M, preferably less than $10^{-8}$ M, more preferably less than $10^{-9}$M, more preferably less than $10^{-10}$M.

In one embodiment, the invention relates to a recombinant binding protein comprising at least a first, a second, a third, and a fourth designed ankyrin repeat domain, wherein said third and fourth designed ankyrin repeat domains each comprise the amino acid sequence of SEQ ID NO: 50. In one embodiment, the invention relates to a recombinant binding protein comprising at least a first, a second, a third, and a fourth designed ankyrin repeat domain, wherein said first designed ankyrin repeat domain comprises the amino acid sequence of SEQ ID NO: 18, and wherein said second designed ankyrin repeat domain comprises the amino acid sequence of SEQ ID NO: 26, and wherein said third and fourth designed ankyrin repeat domains each comprise the amino acid sequence of SEQ ID NO: 50, and wherein said designed ankyrin repeat domains are linked by polypeptide linkers each comprising the amino acid sequence of SEQ ID NO: 9.

In one embodiment the invention relates to a recombinant binding protein comprising at least a first, a second, a third, and a fourth designed ankyrin repeat domain, wherein said first designed ankyrin repeat domain comprises the amino acid sequence of SEQ ID NO: 18, and wherein said second designed ankyrin repeat domain comprises the amino acid sequence of SEQ ID NO: 26, and wherein said third and fourth designed ankyrin repeat domains each comprise the amino acid sequence of SEQ ID NO: 50, and wherein said designed ankyrin repeat domains are linked by polypeptide linkers each comprising the amino acid sequence of SEQ ID NO: 9, and wherein said designed ankyrin repeat domains are arranged (from N-terminal side to C-terminal side): SEQ ID NO: 50-SEQ ID NO: 9-SEQ ID NO: 26-SEQ ID NO: 9-SEQ ID NO: 18-SEQ ID NO: 9-SEQ ID NO: 50.

In one embodiment, the invention relates to a recombinant binding protein comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin, and wherein said designed ankyrin repeat domains are linked by polypeptide linkers each comprising the amino acid sequence of SEQ ID NO: 9, and wherein said recombinant binding protein binds VEGF-A, and/or HGF, preferably VEGF-A with a lower, i.e. better, $EC_{50}$ compared to the recombinant binding protein wherein said designed ankyrin repeat domains are linked by polypeptide linkers each comprising the amino acid sequence SEQ ID NO: 6. Examples of the influence of the linker on $EC_{50}$ are given in Example 8 and the term "lower $EC_{50}$" is well known to the person skilled in the art. Preferably, the term "lower $EC_{50}$" means an $EC_{50}$ value which is improved by a factor of 1.1, more preferably 1.2, 1.3, 1.4, 1.5, 1.6, 1.7, 1.8, 1.9, 2.0.

In one embodiment the invention relates to a recombinant binding protein comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin, wherein said recombinant binding protein binds VEGF-A, and/or HGF, preferably VEGF-A with a lower, i.e. better, $EC_{50}$ compared to the recombinant binding protein comprising only one designed ankyrin repeat domain with binding specificity for serum albumin. Examples are given in Example 8.

In one embodiment, the invention relates to a recombinant binding protein comprising an amino acid sequence that has at least 90%, 91%, 92%, 93%, 94%, 95%, 96%, 97%, 98%, 99%, or 100% amino acid sequence identity with an amino acid sequence selected from the group consisting of amino acid sequences SEQ ID NOs: 134 to 179, preferably SEQ ID NOs: 134 to 158, more preferably SEQ ID NOs: 134 to 149, more preferably SEQ ID NOs: 134 to 140, more preferably SEQ ID NO: 134.

In one embodiment, the invention relates to a recombinant binding protein comprising an amino acid sequence selected from the group consisting of amino acid sequences SEQ ID NOs: 134 to 179, preferably SEQ ID NOs: 134 to 158, more preferably SEQ ID NOs: 134 to 149, more preferably SEQ ID NOs: 134 to 140, more preferably SEQ ID NO: 134, in which up to 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acids are exchanged by any amino acid.

In any embodiment of the present invention relating to a designed ankyrin repeat domain or a recombinant binding protein comprising an amino acid sequence that has at least 90%, 91%, 92%, 93%, 94%, 95%, 96%, 97%, 98%, 99%, or 100% identity to a given amino acid sequence, the non-identical amino acids may be located at any position of the designed ankyrin repeat domain or the recombinant binding protein.

Likewise, in any embodiment of the present invention relating to a designed ankyrin repeat domain or a recombinant binding protein in which up to 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acids are exchanged by any amino acid, the exchanged amino acids amino acids may be located at any position of the designed ankyrin repeat domain.

In one embodiment, the invention relates to a recombinant binding protein comprising an amino acid sequence selected from the group consisting of amino acid sequences SEQ ID NOs: 134 to 179, preferably SEQ ID NOs: 134 to 158, more preferably SEQ ID NOs: 134 to 149, more preferably SEQ ID NOs: 134 to 140, more preferably SEQ ID NO: 134.

The invention particularly relates to a recombinant binding protein comprising an amino acid sequence that has at least 90%, 91%, 92%, 93%, 94%, 95%, 96%, 97%, 98%, 99%, or 100% amino acid sequence identity with the amino acid sequence of SEQ ID NO: 134.

In one embodiment, the invention relates to a recombinant binding protein comprising the amino acid sequence of SEQ ID NO: 134, in which up to 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acids are exchanged by any amino acid.

The invention further particularly relates to a recombinant binding protein comprising the amino acid sequence consisting of the amino acid sequence of SEQ ID NO: 134. In one embodiment, the invention relates to a recombinant binding protein comprising the amino acid sequence of SEQ ID NO: 134.

In one embodiment, the invention relates to a recombinant binding protein consisting of an amino acid sequence selected from the group consisting of amino acid sequences SEQ ID NOs: 134 to 179, preferably SEQ ID NOs: 134 to 158, more preferably SEQ ID NOs: 134 to 149, more preferably SEQ ID NOs: 134 to 140, more preferably SEQ ID NO: 134.

Preferred is SEQ ID NO: 134. Preferred is a recombinant binding protein, wherein the amino acid sequence is SEQ ID NO: 134. Preferred is a protein, wherein the amino acid sequence is SEQ ID NO: 134. Preferred is a recombinant binding protein consisting of the amino acid sequence of SEQ ID NO: 134.

Figure 2:
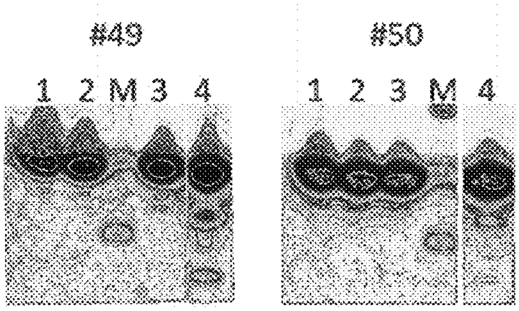
FIG. 2. Improved storage stability of recombinant binding proteins comprising SEQ ID NO: 50. SDS 15% PAGE analysis of Proteins #49 and #50 (corresponding to SEQ ID NOs: 49 and 50, respectively, additionally having SEQ ID NO: 1 at the N terminus; prepared as described in Example 4) stored at 10 mg/ml in PBS for 1 week at 4° C. (1), 25° C. (2), 40° C. (3), and 60° C. (4), respectively. M: Marker (lower band: 6.5 kDa; band at Protein #50 level: 14.4 kDa; upper band in case of Protein #50 PAGE: 21.5 kDa).

Multiple features make SEQ ID NO: 134 the preferred recombinant binding protein of the invention. It comprises two designed ankyrin repeat domains with binding specificity for serum albumin each consisting of SEQ ID NO: 50, which shows improved storage stability properties (see Example 9; FIG. 2) compared to known designed ankyrin repeat domain with binding specificity for serum albumin. It comprises two designed ankyrin repeat domains with binding specificity for serum albumin, which surprisingly leads to improved pharmacokinetic properties (Examples 5 and 6, FIGS. 3A-3D and FIGS. 4A-4B). The two designed ankyrin repeat domains with binding specificity for serum albumin are flanking the other designed ankyrin repeat domains leading to the best pharmacokinetic properties observed (Example 6). The designed ankyrin repeat domains and with binding specificity for VEGF-A and HGF as well as their structural arrangement were chosen to maximize activity of the compound (Example 8). The designed ankyrin repeat domains are connected using a PT-rich linker, surprisingly leading to improved activity of the individual designed ankyrin repeat domains (Example 8) and surprisingly leading to improved pharmacokinetic properties (Example 5).

In one embodiment, the invention relates to a recombinant binding protein comprising at least a first, a second, a third, and a fourth designed ankyrin repeat domain, wherein said first designed ankyrin repeat domain has binding specificity for VEGF-A, and wherein said second designed ankyrin repeat domain has binding specificity for HGF, and wherein said third and fourth designed ankyrin repeat domains each have binding specificity for serum albumin, and wherein said first, second, third, and fourth designed ankyrin repeat domain are linked by polypeptide linkers, and wherein said recombinant binding protein exhibits an increase in terminal half-life, preferably an increase in terminal half-life of at least 5%, 10%, 15%, 20%, 25%, 30%, 35%, 40%, or 45%, compared to the recombinant binding protein lacking said fourth designed ankyrin repeat domain with binding specificity for serum albumin. Examples of such an increase in terminal half-life are given in Examples 5 and 6 and FIGS. 3A-3D and FIGS. 4A-4B.

In one embodiment, the invention relates to a nucleic acid encoding the amino acid sequence of a designed ankyrin repeat domain or a recombinant binding protein of the present invention, more preferably a recombinant binding protein of the present invention. In one embodiment, the invention relates to a nucleic acid encoding the amino acid sequence of any recombinant binding protein of the present invention comprising at least two, more preferably comprising two, designed ankyrin repeat domains with binding specificity for serum albumin. In one embodiment, the invention relates to a nucleic acid encoding the amino acid sequence of a recombinant binding protein of the present invention. Furthermore, the invention relates to vectors comprising any nucleic acid of the invention. Nucleic acids are well known to the skilled person. In the examples, nucleic acids were used to produce designed ankyrin repeat domains or recombinant binding proteins of the invention in *E. coli.*

In one embodiment, the invention relates to a pharmaceutical composition comprising a recombinant binding protein and/or a designed ankyrin repeat domain of the present invention, or a nucleic acid encoding a recombinant binding protein and/or a designed ankyrin repeat domain of the present invention, and optionally a pharmaceutically acceptable carrier and/or diluent.

In one embodiment, the invention relates to a pharmaceutical composition comprising a recombinant binding protein or a nucleic acid encoding a recombinant binding protein, and optionally a pharmaceutically acceptable carrier and/or diluent.

Pharmaceutical acceptable carriers and/or diluents are known to the person skilled in the art and are explained in more detail below. Even further, a diagnostic composition comprising one or more of the above mentioned recombinant binding proteins and/or designed ankyrin repeat domains, and/or nucleic acids, in particular recombinant binding proteins, is considered.

A pharmaceutical composition comprises a recombinant binding protein, and/or a designed ankyrin repeat domain, and/or a nucleic acid as described herein and a pharmaceutically acceptable carrier, excipient or stabilizer, for example as described in Remington's Pharmaceutical Sciences $16^{th}$ edition, Osol, A. Ed., 1980. Suitable carriers, excipients or stabilizers known to the skilled man are saline, Ringer's solution, dextrose solution, Hank's solution, fixed oils, ethyl oleate, 5% dextrose in saline, substances that enhance isotonicity and chemical stability, buffers and preservatives. Other suitable carriers include any carrier that does not itself induce the production of antibodies harmful to the individual receiving the composition such as proteins, polysaccharides, polylactic acids, polyglycolic acids, polymeric amino acids and amino acid copolymers. A pharmaceutical composition may also be a combination formulation, comprising an additional active agent, such as an anti-cancer agent or an anti-angiogenic agent, or an additional bioactive compound.

One embodiment of the present invention relates to the use of a recombinant binding protein of the present invention comprising at least two, preferably comprising two, designed ankyrin repeat domains with binding specificity for serum albumin for manufacturing a pharmaceutical composition, wherein said recombinant binding protein exhibits an increased terminal half-life, preferably an increased terminal half-life of at least 5%, preferably 10%, 15%, 20%, 25%, 30%, 35%, 40%, 45%, 50%, 60%, 70%, 80%, 90%, 100%, 150%, 200%, or 250%, compared to the recombinant binding protein comprising only one designed ankyrin repeat domain with binding specificity for serum albumin.

In one embodiment, a pharmaceutical composition comprises at least one recombinant binding protein as described herein and a detergent such as nonionic detergent, a buffer such as phosphate, and a sugar such as sucrose. In one embodiment, such a composition comprises recombinant binding proteins as described above and PBS.

In one embodiment, the invention relates to the use of a pharmaceutical composition, or a recombinant binding protein according to the present invention for the treatment of a disease. For that purpose, the pharmaceutical composition, or the recombinant binding protein according to the present invention is administered, to a patient in need thereof, in a therapeutically effective amount. Administration may include topical administration, oral administration, and parenteral administration. The typical route of administration is parenteral administration. In parental administration, the medicament of this invention will be formulated in a unit dosage injectable form such as a solution, suspension or emulsion, in association with the pharmaceutically acceptable excipients as defined above. The dosage and mode of administration will depend on the individual to be treated and the particular disease.

Further, any of the above mentioned pharmaceutical composition or recombinant binding protein is considered for the treatment of a disorder.

A pharmaceutical composition of the present invention may be administered by e.g. parenteral administration. In parental administration, the medicament of this invention will be formulated in a unit dosage injectable form such as a solution, suspension or emulsion, in association with the pharmaceutically acceptable excipients as defined above. The dosage and mode of administration will depend on the individual to be treated and the particular disease. In one embodiment, said recombinant binding protein or such other pharmaceutical composition described herein is applied intravenously. For parenteral application, the recombinant binding protein or said pharmaceutical composition can be injected as bolus injection or by slow infusion at a therapeutically effective amount.

In one embodiment, the invention relates to a method of treatment of a medical condition, the method comprising the step of administering, to a patient in need of such a treatment, a therapeutically effective amount of a recombinant binding protein of the invention. In one embodiment, the invention relates to a method of treatment of a medical condition, the method comprising the step of administering, to a patient in need of such a treatment, a therapeutically effective amount of a pharmaceutical composition of the invention. Example 14 (FIGS. 10A-10C) illustrates the utility of the use of a recombinant binding protein consisting of SEQ ID NO: 134 for the treatment of cancer. In one embodiment, the invention relates to the use of a pharmaceutical composition of the present invention for the treatment of a disease. In one embodiment, the invention relates to a pharmaceutical composition for use in the treatment of a disease.

A "medical condition" (or disorder) may be one that is characterized by inappropriate angiogenesis. A medical condition may be a hyperproliferative condition. Examples of medical conditions suitable for treatment include autoimmune disorders, inflammatory disorders, retinopathies (particularly proliferative retinopathies), neurodegenerative disorders, infections, and neoplastic diseases. Any of the recombinant binding proteins described herein may be used for the preparation of a medicament for the treatment of such a disorder, particularly a disorder selected from the group consisting of: an autoimmune disorder, an inflammatory disorder, a retinopathy, and a neoplastic disease. The invention particularly relates to a method of treating a medical condition, the method comprising the step of administering, to a patient in need of such treatment, a therapeutically effective amount of a recombinant binding protein or said pharmaceutical composition of the invention. In some embodiments said medical condition is a neoplastic disease. The term "neoplastic disease", as used herein, refers to an abnormal state or condition of cells or tissue characterized by rapidly proliferating cell growth or neoplasm. In a more specific meaning, the term relates to cancer. In a more specific meaning, the term may relate to renal cancer and/or gastric cancer and/or multiple myeloma. The term "therapeutically effective amount" means an amount that is sufficient to produce a desired effect on a patient.

In particular, the invention relates to the treatment of a medical condition using a pharmaceutical composition of the present invention, wherein said medical condition is cancer.

The use of a recombinant binding protein of the present invention or said pharmaceutical compositions for the treatment of cancer diseases can also be in combination with any other therapy known in the art. The term "use in combination with", as used herein, shall refer to a coadministration, which is carried out under a given regimen. This includes synchronous administration of the different compounds as well as time-shifted administration of the different compounds (e.g. compound A is given once and compound B is given several times thereafter, or vice versa, or both compounds are given synchronously and one of the two is also given at later stages).

The use of a recombinant protein for the treatment of a disease including pathological angiogenesis is further considered. The term "pathological angiogenesis" refers to the formation and growth of blood vessels during the maintenance and the progression of several disease states.

In a further embodiment, the invention relates to the use of a recombinant binding protein of the invention for the manufacture of a medicament that is used for the treatment of a medical condition, preferably a neoplastic disease, more preferably cancer.

In one embodiment, the invention relates to the use of a pharmaceutical composition of the invention for the manufacture of a medicament that is used for the treatment of a medical condition, which may be a neoplastic disease, in particular cancer.

The formulations to be used for in vivo administration must be aseptic or sterile. This is readily accomplished by filtration through sterile filtration membranes.

The term "selected from the group consisting of" in connection with a single choice in this invention has the meaning of that particular choice. For example, in one embodiment, "the invention relates to a recombinant binding protein comprising an amino acid sequence selected from the group consisting of amino acid sequences SEQ ID NO: 134", which has the meaning "the invention relates to a recombinant binding protein comprising the amino acid sequence of SEQ ID NO: 134".

In one embodiment the invention relates to a recombinant binding protein comprising any of the above mentioned repeat domains. In one embodiment, the invention relates to a recombinant binding protein comprising any of the above mentioned SEQ ID NO: 134 to 179.

The invention is not restricted to the particular embodiments described in the Examples. Other sources may be used and processed following the general outline described below.

A number of documents are cited throughout this specification. The disclosure content of these documents is herewith incorporated by reference.

This specification refers to a number of amino acid sequences of the amino acid sequence listing of this specification named "P014_Sequence_Protocol.txt" and the amino acid sequences of the sequence protocol are herewith incorporated by reference.

EXAMPLES

All of the standard materials and reagents disclosed here are known to those skilled in the art, and are available commercially or can be prepared using well-known techniques.

Materials Chemicals were purchased from Sigma-Aldrich (Switzerland). Oligonucleotides were from Microsynth (Switzerland). Unless stated otherwise, DNA polymerases, restriction enzymes and buffers were from New England Biolabs (USA) or Thermo Fisher Scientific Fermentas (Lithuania). The cloning and protein production strain was *E. coli* XL1-blue (Stratagene, USA) or BL21 (Novagen, USA). Recombinant VEGF-A (human, mouse, rat), VEGF-C, PDGF-AB, and HGF (human, cynomolgus monkey, mouse) were from R&D Systems (Biotechne; Minneapolis, USA), Peprotech (Rocky Hill, USA), Sino Biological (Beijing, China), ReliaTech (Wolfenbüttel, Germany) or produced in Chinese Hamster Ovary Cells or in *Pichia pastoris* and purified according to standard protocols. Serum albumin of different species were from Sigma-Aldrich, Innovative Research (Novi, USA), CSL Behring (Switzerland), or collected from animals directly using standard methods. Biotinylated VEGF-A or HGF were obtained chemically via coupling of the biotin moiety to primary amines of the protein using standard biotinylation reagents and methods (Thermo Fisher Scientific Inc., USA). Antibodies were from Thermo Fisher Scientific or QIAgen (Germany), or were generated using standard immunization and hybridoma procedures in mice or rabbits, procedures well known to the person skilled in the relevant art. Cell culture reagents were from Lonza (Switzerland), Roche (Switzerland), Thermo Fisher Scientific, and Promocell (Germany).

Molecular Biology

Unless stated otherwise, methods are performed according to described protocols (Sambrook J., Fritsch E. F. and Maniatis T., Molecular Cloning: A Laboratory Manual, Cold Spring Harbor Laboratory 1989, New York).

Designed Ankyrin Repeat Domains, Libraries and Selections

Methods to generate designed ankyrin repeat protein libraries, examples of designed ankyrin repeat protein libraries, and methods to select designed ankyrin repeat proteins from libraries of designed ankyrin repeat proteins are described (WO 2002/020565; WO 2010/060748; WO 2012/069654; WO 2012/069655; WO 2014/001442; Binz et al. 2004, loc. cit.).

Example 1

Selection, Expression, Purification, and Analysis of Designed Ankyrin Repeat Domains with Binding Specificity for VEGF-A, HGF, or Serum Albumin Using ribosome display (Binz et al., 2004, loc. cit.) designed ankyrin repeat domains with binding specificity for VEGF-A, HGF, or serum albumin were selected from combinatorial libraries by methods described in WO 2010/060748 for the generation of designed ankyrin repeat domains with binding specificity for VEGF-A, and by methods described in WO 2014/191574 for the generation of designed ankyrin repeat domains with binding specificity for HGF, and by methods described in WO 2012/069654 for the generation of designed ankyrin repeat domains with binding specificity to serum albumin. The binding of the selected clones toward specific (VEGF-A, HGF, or serum albumin, respectively) and unspecific (e.g. MBP, *E. coli* maltose binding protein) targets was assessed by crude extract ELISA, indicating that hundreds of designed ankyrin repeat domains with binding specificity to VEGF-A, HGF, or serum albumin, respectively, were successfully selected in each selection for the respective target. For example, the designed ankyrin repeat domains of SEQ ID NO: 12 to 22 constitute amino acid sequences of ankyrin repeat domains with binding specificity for VEGF-A, the designed ankyrin repeat domains of SEQ ID NO: 23 to 37 constitute amino acid sequences of designed ankyrin repeat domains with binding specificity for HGF, and the designed ankyrin repeat domains of SEQ ID NO: 40 to 56 constitute amino acid sequences of designed ankyrin repeat domains with binding specificity for serum albumin.

These designed ankyrin repeat domains with binding specificity for VEGF-A, HGF, or serum albumin, and negative control designed ankyrin repeat domains with no known binding specificity (i.e. Proteins #10 and #11) were cloned into a pQE (QIAgen, Germany) based expression vector providing an N-terminal His-tag to facilitate simple protein purification. The proteins were produced and purified with methods known to the person skilled in the art such as described for example in WO 2010/060748.

Example 2

Characterization of Designed Ankyrin Repeat Domains Using Surface Plasmon Resonance SPR was measured using a Protein instrument (BioRad) and measurement was performed according standard procedures known to the person skilled in the art. Kd values that were measured for selected proteins are listed in Tables 1 to 3.

TABLE 1

Examples of dissociation constants of designed ankyrin repeat domains bindind to human VEGF-A

| Protein #* | Kd [pM] |
|---|---|
| 12 | 94 |
| 13 | 96 |
| 16 | 141 |

* Protein #12, #13, and #16 in this table represent designed ankyrin repeat domains consisting of the corresponding amino acid sequence of SEQ ID NO: 12, 13 and 16, and additionally an N-terminal His-tag (SEQ ID NO: 1).
Similar VEGF-A dissociation constant values are obtained for Proteins #14, #15, and #17 to #22.

TABLE 2

Examples of dissociation constants of designed ankyrin repeat domains binding to human HGF

| Protein #* | Kd [pM] |
|---|---|
| 23 | 16 |
| 24 | 163 |
| 25 | 66 |
| 26 | 51 |
| 27 | 129 |
| 28 | 26 |
| 29 | 25 |

*Protein #23 to #29 in this table represent designed ankyrin repeat domains consisting of the corresponding amino acid sequence of SEQ ID NO: 23 to 29, and additionally an N-terminal His-tag (SEQ ID NO: 1).
Similar HGF dissociation constant values are obtained for Proteins #30 to #37.

TABLE 3

Examples of dissociation constants of designed ankyrin repeat domains binding to human HSA

| Protein #* | Kd [nM] |
|---|---|
| 44 | 26 |
| 45 | 13 |
| 46 | 22 |
| 47 | 27 |
| 48 | 20 |
| 49 | 15 |
| 50 | 27 |
| 51 | 14 |
| 52 | 6 |
| 54 | 11 |
| 55 | 15 |

*Protein #44, to #55 in this table represent designed ankyrin repeat domains consisting of the corresponding amino acid sequence of SEQ ID NO: 44, 45, 46, 47, 48, 49, 50, 51, 52, 54, and 55, and additionally an N-terminal His-tag (SEQ ID NO: 1).
Similar human serum albumin dissociation constant values are obtained for Proteins #40 to #43, #53, #56, and #57.

Example 3

Competition Binding Assays and Receptor Competition Binding Assays

Characterization of designed ankyrin repeat domains with binding specificity for VEGF-A, HGF, or serum albumin, respectively, by competition assays. Such assays are well known to the person skilled in the art. For designed ankyrin repeat domains with binding specificity to VEGF-A, a quantitative sandwich enzyme immunoassay technique was used according to the manufacturer (VEGF-A Quantikine kit DVE00, R&D Systems). A monoclonal antibody specific for VEGF-A was pre-coated onto a microplate. VEGF-A standards and mixtures of VEGF-A (20 pM) and Protein #18, #19, or #20 at varying concentrations were applied to the wells and any free VEGF-A present (i.e. not bound to the designed ankyrin repeat domain) is bound by the immobilized antibody. After washing away any unbound substances, an enzyme-linked polyclonal antibody specific for VEGF-A is added to the wells. Following a wash to remove any unbound antibody-enzyme reagent, a substrate solution is added to the wells and color develops in proportion to the amount of VEGF-A bound in the initial step. The color development is stopped and the intensity of the color is measured. In this assay, the tested designed ankyrin repeat proteins showed high VEGF-A inhibition potency. $IC_{50}$ values were calculated from such titration curves obtained as described above using Graph Pad Prism software and standard procedures known to the person skilled in the art. For designed ankyrin repeat domains with binding specificity to HGF, a cMet receptor competition assay was performed. For that purpose, 5 nM of human cMet receptor in PBS were immobilized on Maxisorp plates overnight at 4° C. After washing with PBS 0.05% TWEEN 20, the plate was blocked for 2 h with shaking at 300 rpm using PBS containing 0.05% TWEEN 20 and 0.25% Casein at RT. A constant concentration of 5 nM human HGF was pre-incubated for 30 min at RT with a 1000 nM-1 μM of Proteins #23, #26, #28, and #29 (1:4 dilution series each) on a dilution plate in PBS 0.05% TWEEN 20. After washing of the ELISA plate with PBS 0.05% TWEEN, pre-incubated samples were transferred to the ELISA plate and plate was incubated for 2 h at RT with shaking at 300 rpm. After washing with PBS 0.25% TWEEN, 200 ng/ml anti human HGF antibody was added for 1 h at RT with shaking at 300 rpm. After washing with PBS 0.05% TWEEN, 100 ng/ml HRP conjugated polyclonal anti HGF species antibody was added for 30 min at RT with shaking at 300 rpm. Detection was using 1:3 diluted BM blue POD (Roche). Color reaction was stopped after 15 min by addition of 1 M H2SO4. Readout was done at A450 using A620 as reference wavelength. Example $IC_{50}$ values obtained by these assays are given in Tables 4 and 5. Similar VEGF-A $IC_{50}$ values are obtained with Proteins #12 to #17, #21, and similar HGF $IC_{50}$ values are obtained with Proteins #24, #25, #27, and #30 to #37.

TABLE 4

Inhibition of the VEGF-A-bindinq of an antibody by designed domains (mean $IC_{50}$ values)

| Protein #* | $IC_{50}$ [pM] |
|---|---|
| #18 | 13 |
| #19 | 13 |
| #20 | 4 |

*Protein #18 to #20 in this table represent designed ankyrin repeat domains consisting of the corresponding amino acid sequence of SEQ ID NO: 18 to 20, and additionally an N-terminal His-tag (SEQ ID NO: 1).

TABLE 5

| Inhibition of HGF bindina to cMET by designed ankyrin repeat domains (mean $IC_{50}$ values) | |
|---|---|
| Protein #* | $IC_{50}$ [pM] |
| 23 | 915 |
| 26 | 623 |
| 28 | 955 |
| 29 | 1357 |

*Protein #23, #26, #28, and #29 in this table represent designed ankyrin repeat domains consisting of the corresponding amino acid sequence of SEQ ID NO: 23, 26, 28, and 29, and additionally an N-terminal His-tag (SEQ ID NO: 1).

Example 4

Generation of Recombinant Binding Proteins, in Particular Recombinant Proteins Comprising Two, Three or Four Designed Ankyrin Repeat Domains, and Other Repeat Proteins DNA encoding designed ankyrin repeat domains or recombinant binding proteins was generated by genetic means well known to the person skilled in the art. Recombinant binding proteins selected from the group of amino acid sequences SEQ ID NOs: 58 to 133, additionally having SEQ ID NO: 1 or the amino acids GS at the N terminus or recombinant binding proteins selected from the group of amino acid sequences SEQ ID NOs: 134 to 179, or designed ankyrin repeat domains selected from the group of amino acid sequences SEQ ID NOs: 10 to 57, additionally having SEQ ID NO: 1 or the amino acids GS at the N terminus, were expressed in the cytoplasm of *Escherichia coli* using standard techniques using the pQE expression system from Qiagen (Germany). In case the amino acids GS were at the N terminus, the Met residue additionally encoded by the expression vector was efficiently cleaved off in the cytoplasm of *E. coli* from the expressed polypeptide since the start Met is followed by a small Gly residue (i.e. the amino acid at position 1 of SEQ ID NOs: 134 to 179). The cells were lysed by using a French press, and the proteins were purified to near homogeneity from the crude cell extract by using standard chromatographic techniques well known to the person in the art.

Example 5

Improving Pharmacokinetic Properties with Increasing Numbers of Designed Ankyrin Repeat Domains with Binding Specificity for Serum Albumin Comprised in a Recombinant Binding Protein—Mouse Pharmacokinetic Studies For mouse pharmacokinetic studies Proteins #57, #62, #63, #64, #68, #73, #74, #82, #83, #97, #109, and #110 (proteins corresponding to SEQ ID NOs: 57, 62, 63, 64, 68, 73, 74, 82, 83, 97, 109, and 110, additionally having SEQ ID NO: 1 at the N terminus) prepared as described in Example 4, were labeled radioactively as described (Zahnd, C., Kawe, M., Stumpp, M. T., de Pasquale, C., Tamaskovic, R., Nagy-Davidescu, G., Dreier, B., Schibli, R., Binz, H. K., Waibel, R., Plückthun, A., Cancer Res. 70, 1595-1605, 2010) and administered at 10 μg in 100 μl as a single intravenous bolus injection into the tail vein of female BALB/c mice, respectively. Serum samples from each mouse were collected at various time points and the accumulated radioactivity was determined using a gamma-scintillation counter.

Figure 3A:
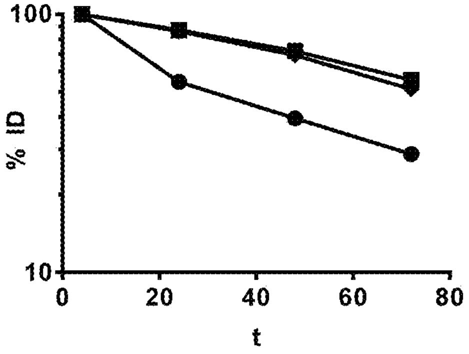
FIG. 3A. Mouse pharmacokinetic studies illustrating the benefit of having two designed ankyrin repeat domains with binding specificity for serum albumin in a recombinant binding protein. Mouse pharmacokinetic studies were performed using $^{m99}$Tc labeled proteins as described in Example 5. The percentage injected dose (% ID), referenced to an early measurement time point (a: 4 h; b-d: 1 h) is shown over time (t; hours). Proteins used comprised an N-terminal His-tag (SEQ ID NO: 1) in addition to the sequence indicated unless stated otherwise.
Figure 3B:
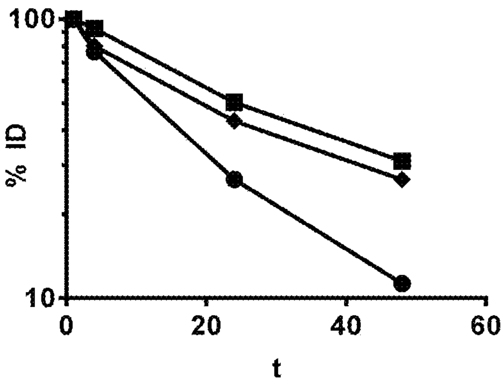
FIG. 3B. Mouse pharmacokinetic studies illustrating the benefit of having two designed ankyrin repeat domains with binding specificity for serum albumin in a recombinant binding protein. Mouse pharmacokinetic studies were performed using m$^{99}$Tc labeled proteins as described in Example 5. The percentage injected dose (% ID), referenced to an early measurement time point (a: 4 h; b-d: 1 h) is shown over time (t; hours). Proteins used comprised an N-terminal His-tag (SEQ ID NO: 1) in addition to the sequence indicated unless stated otherwise.
Figure 3C:
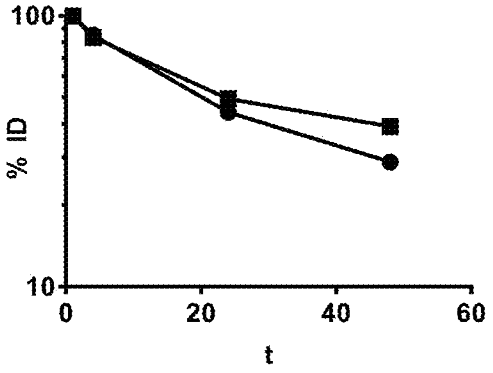
FIG. 3C. Mouse pharmacokinetic studies illustrating the benefit of having two designed ankyrin repeat domains with binding specificity for serum albumin in a recombinant binding protein. Mouse pharmacokinetic studies were performed using $^{m99}$Tc labeled proteins as described in Example 5. The percentage injected dose (% ID), referenced to an early measurement time point (a: 4 h; b-d: 1 h) is shown over time (t; hours). Proteins used comprised an N-terminal His-tag (SEQ ID NO: 1) in addition to the sequence indicated unless stated otherwise.
Figure 3D:
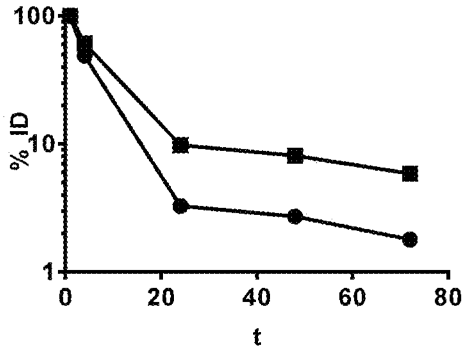
FIG. 3D. Mouse pharmacokinetic studies illustrating the benefit of having two designed ankyrin repeat domains with binding specificity for serum albumin in a recombinant binding protein. Mouse pharmacokinetic studies were performed using $^{m99}$Tc labeled proteins as described in Example 5. The percentage injected dose (% ID), referenced to an early measurement time point (a: 4 h; b-d: 1 h) is shown over time (t; hours). Proteins used comprised an N-terminal His-tag (SEQ ID NO: 1) in addition to the sequence indicated unless stated otherwise.

In these experiments, proteins comprising two designed ankyrin repeat domains with binding specificity for serum albumin consistently exhibited improved pharmacokinetic properties compared to comparable constructs comprising only one designed ankyrin repeat domain with binding specificity for serum albumin (FIGS. 3A-3D). For example, the comparison of Protein #57, which comprises a single designed ankyrin repeat domain with binding specificity for serum albumin (SEQ ID NO: 57, comprising SEQ ID NO: 51 plus a C-terminal polypeptide) with Proteins #62 and #63, which comprise two designed ankyrin repeat domains with binding specificity for serum albumin (two times SEQ ID NO: 51, linked by GS—(SEQ ID NO: 63) or PT-rich (SEQ ID NO: 62) polypeptide linkers) shows that having two designed ankyrin repeat domains with binding specificity for serum albumin leads to higher % ID at e.g. 24 h (+57% GS; +59% PT), 48 h (+76% GS; +82% PT) or 72 h (+79% GS; +94% PT) post-injection, and leads to an improved terminal half-life (+38% GS; +48% PT) compared to the protein comprising only a single designed ankyrin repeat domain with binding specificity for serum albumin (FIG. 3A). In particular, using a PT-rich linker, in particular SEQ ID NO: 9, leads to improved pharmacokinetic properties (FIG. 3A). The following three examples show that the method of improving pharmacokinetic properties by having two (instead of one) designed ankyrin repeat domains with binding specificity for serum albumin present in a protein, is transferable to different proteins comprising different designed ankyrin repeat domains. For example, the comparison of the pharmacokinetic profile of Protein #64, comprising SEQ ID NOs: 22 (designed ankyrin repeat domain with binding specificity for another target than serum albumin) and 51 (designed ankyrin repeat domain with binding specificity for serum albumin), with Proteins #73 and #74, comprising each SEQ ID NOs: 22 and two times 51 (Protein #73 has SEQ ID NOs: 51 flanking SEQ ID NO: 22, and Protein #74 has SEQ ID NOs: 51 N-terminal of SEQ ID NO: 22) shows that having two designed ankyrin repeat domains with binding specificity for serum albumin leads to higher % ID at e.g. 24 h (+62% N-terminal; +89% flanking), or 48 h (+136% N-terminal; +175% flanking) post-injection, and leads to an improved terminal half-life (+>63% for both N-terminal or flanking) compared to the protein comprising only a single designed ankyrin repeat domain with binding specificity for serum albumin (FIG. 3B). Likewise, a pharmacokinetic profile comparison of Protein #82, comprising twice SEQ ID NO: 11 (designed ankyrin repeat domain with no known binding specificity) and once SEQ ID NO: 51 (designed ankyrin repeat domain with binding specificity for serum albumin), with Protein #109, comprising twice SEQ ID NO: 11 and twice SEQ ID NO: 51 (N-terminal), indicates that having two designed ankyrin repeat domains with binding specificity for serum albumin leads to higher % ID at e.g. 24 h (+12%), or 48 h (+35%) post-injection, and leads to an improved terminal half-life (+71%) compared to the protein comprising only a single designed ankyrin repeat domain with binding specificity for serum albumin (FIG. 3C). Furthermore, the pharmacokinetic profile comparison of Protein #83, comprising SEQ ID NOs: 38 and 39 (designed ankyrin repeat domains each with binding specificity for another target than serum albumin) and 50 (designed ankyrin repeat domain with binding specificity for serum albumin), with Proteins #110, comprising each SEQ ID NOs: 38 and 39 and twice SEQ ID NO: 50 (flanking SEQ ID NOs: 38 and 39), shows that having two designed ankyrin repeat domains with binding specificity for serum albumin leads to higher % ID at e.g. 24 h (+198%), 48 h (+198%), or 72 h (+228%) post-injection, and leads to an improved terminal half-life (+19%) compared to the protein comprising only a single designed ankyrin repeat domain with binding specificity for serum albumin (FIG. 3D). Furthermore, Protein #97 exhibited significantly improved pharmacokinetic properties over Protein #68, e.g. the terminal half-lives were 21 and 16 hours, respectively, indicating that having two designed ankyrin repeat domains with binding specificity for serum albumin is beneficial over having only one such domain.

These results indicate, surprisingly, that using two designed ankyrin repeat domains with binding specificity for serum albumin instead of one in a recombinant binding protein leads to improved pharmacokinetic properties, as discussed further in Example 6.

Example 6

Figure 4A:
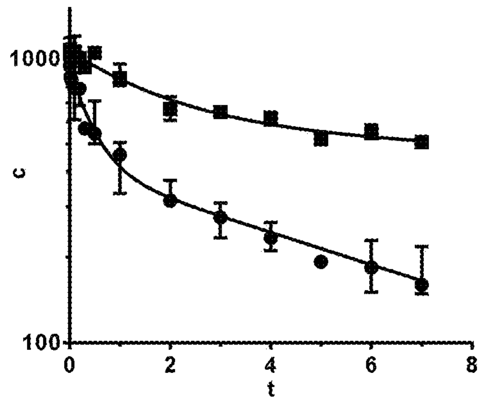
FIG. 4A. Cynomolgus monkey pharmacokinetic studies illustrating the benefit of having two designed ankyrin repeat domains with binding specificity for serum albumin in a recombinant binding protein. Cynomolgus monkey pharmacokinetic studies were performed as described in Example 6. The concentration of the respective protein is shown in nM over time indicated in days. Proteins used comprised an N-terminal His-tag (SEQ ID NO: 1) in addition to the sequence indicated unless stated otherwise.
Figure 4B:
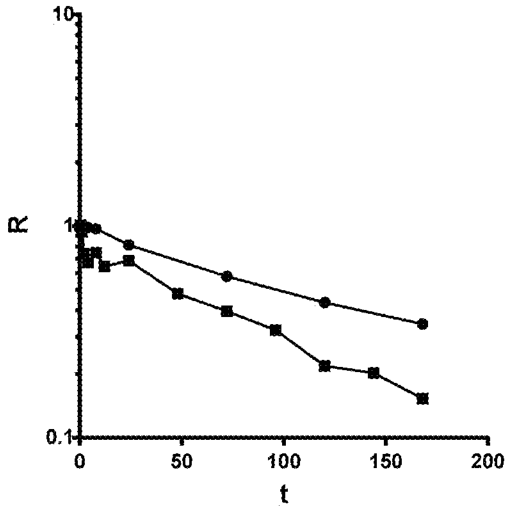
FIG. 4B. Cynomolgus monkey pharmacokinetic studies illustrating the benefit of having two designed ankyrin repeat domains with binding specificity for serum albumin in a recombinant binding protein. Cynomolgus monkey pharmacokinetic studies were performed as described in Example 6. The concentration of the respective protein is shown as relative value referenced to the measurement point at 10 minutes post-injection, over time indicated in hours. Proteins used comprised an N-terminal His-tag (SEQ ID NO: 1) in addition to the sequence indicated unless stated otherwise.

Improving Pharmacokinetic Properties with Increasing Numbers of Designed Ankyrin Repeat Domains with Binding Specificity for Serum Albumin Comprised in a Recombinant Binding Protein—Cynomolgus Monkey Pharmacokinetic Studies For cynomolgus monkey pharmacokinetic studies Proteins #57, #62, and #97 (proteins corresponding to SEQ ID NOs: 57, 62, and 97, additionally having SEQ ID NO: 1 at the N terminus) and Protein #134 (a protein corresponding to SEQ ID NOs: 134), prepared as described in Example 4, were administered via intravenous infusion for 30 min at a target dose level of between 0.5-100 mg/kg to cynomolgous monkeys. Blood samples were collected pre-dose and again at selected time points, for example 5 min, 10 min, 0.5 h, 1 h, 2 h, 4 h, 8 h, 12 h, 24 h, 48 h, 72 h, 96 h, 120 h and 168 h post-end of infusion (i.e. post-injection). The blood samples were allowed to stand at room temperature and were centrifuged to generate serum, followed by storage at −80° C. pending analyses. Pharmacokinetic parameters were determined using procedures well known to the person skilled in the art. Serum concentrations of Proteins #57, #62, #97 and #134 were determined by sandwich ELISA using a rabbit monoclonal anti-designed ankyrin repeat domain antibody as capture reagent and murine monoclonal anti-designed ankyrin repeat domain antibody as detection reagent, and using a standard curve. Pharmacokinetic parameters were determined using standard software such as Phoenix WinNonLin (Certara, Princeton, USA) or GraphPadPrism (GraphPad Software, La Jolla, USA) and standard analyses such as non-compartmental analyses. The resulting pharmacokinetic profiles are shown in FIGS. 4A-4B. Proteins comprising two designed ankyrin repeat domains with binding specificity for serum albumin consistently exhibited improved pharmacokinetic properties compared to comparable constructs comprising only one designed ankyrin repeat domain with binding specificity for serum albumin. For example by comparing Protein #57 (0.5 mg/Kg; 27.7 nmol/kg), comprising a single designed ankyrin repeat domain with binding specificity for serum albumin (SEQ ID NO: 51), with Protein #62 (1.04 mg/Kg; 34.5 nmol/kg), a protein comprising two designed ankyrin repeat domains with binding specificity for serum albumin (twice SEQ ID NO: 51, linked by a PT-rich polypeptide linker), the results show that having two designed ankyrin repeat domains with binding specificity for serum albumin in a protein leads to higher exposure (2138 d*nmol/L vs. 4676 d*nmol/L, i.e. +119% calculated up to day 7), leads to a reduced clearance (0.0108 L/(d*kg) vs. 0.0031 L/(d*kg); i.e. −71%), and leads to an improved terminal half-life (4.57 d vs. 9.00 d, i.e. +97% calculated from day 1 to day 7) compared to the protein comprising only a single designed ankyrin repeat domain with binding specificity for serum albumin (FIG. 4A). Also, the percentage injected dose, normalized to the concentration measured 10 min post-injection, is increased comparing Protein #57 with Protein #62 at day 4 (23.39% vs. 57.72%; +148%), day 5 (19.00% vs. 48.41%; +155%), and day 6 (18.5% vs. 51.94%; +175%). As a further example in cynomolgus monkey, Protein #134 (a protein corresponding to SEQ ID NOs: 134, produced as descried in Example 4, was tested at different doses in 10 animals each (5 male, 5 female, each dose) and the terminal half-life was evaluated using WinNonLin considering concentration values up to day 7. Protein #134 exhibited an average terminal half-life of 4.0 days (95 h) when given at 1 mg/kg (compared to Protein #97 exhibiting 2.7 days (65 h) terminal half-life at 1 mg/kg (+46%)), 5.3 days (127 h) when given at 10 mg/kg, and 5.8 days (139 h) when given at 100 mg/kg to cynomolgus monkey. The pharmacokinetic profile of Protein #134 in comparison to Protein #97 in cynomolgus monkey is shown in FIG. 4B. Like in Example 5, these results indicate, surprisingly, that using two designed ankyrin repeat domains with binding specificity for serum albumin instead of one in a recombinant binding protein leads to improved pharmacokinetic properties. These results are discussed in the following.

In the absence of any albumin binding activity, a recombinant binding protein has a terminal half-life in the range of minutes both in mouse and cynomolgus monkey (See WO 2012/069654). Proteins comprising at least one designed ankyrin repeat domain with binding specificity for serum albumin show terminal half-lives which are far greater than if no designed ankyrin repeat domain with binding specificity for serum albumin is present. A pharmacokinetic profile of a protein comprising one designed ankyrin repeat domain with binding specificity for serum albumin are shown in FIG. 3A and FIG. 4A.

The art contains a study, in which the effect of valency of another serum albumin binding protein domain, the albumin binding domain (ABD) derived from streptococcal protein G, was investigated (Hopp et al., 2010; loc. cit.). Another study uses C-terminally fused peptides (WO 2011/095545), which are no protein domains. ABD is a helical protein domain with binding specificity for serum albumin. Importantly, Hopp et al. 2010 (loc. cit.) show that having two such ABDs (one N-terminal and one C-terminal) in a recombinant binding protein does not lead to a significantly improved terminal half-life in mouse compared to a recombinant binding protein comprising only one ABD (C-terminal; 37.9±1.1 h vs. 36.4±4.8 h). In particular, at 24 h and 72 h post injection, the recombinant binding protein comprising one ABD showed identical percentage injected doses as the recombinant binding protein comprising two ABD, indicating equivalent pharmacokinetic properties of the two recombinant binding proteins. Based on the findings with ABD, one skilled in the art would expect that a recombinant binding protein comprising two albumin binding protein domains such as designed ankyrin repeat domains with binding specificity for serum albumin would not have improved pharmacokinetic properties compared to a recombinant binding protein comprising only one designed ankyrin repeat domain with binding specificity for serum albumin. Surprisingly, we found that this is not the case. In contrast to Hopp et al. (loc. cit.), recombinant binding proteins comprising two designed ankyrin repeat domains with binding specificity for serum albumin surprisingly exhibited clearly prolonged terminal half-lives compared to recombinant binding proteins comprising only one designed ankyrin repeat domain with binding specificity for serum albumin.

These examples illustrate a number of additional findings. For example, the pharmacokinetic properties of Protein #134 are superior to the ones of Protein #97, illustrating the importance of the choice of the individual designed ankyrin repeat domains. SEQ ID NO: 134 was chosen to be composed of components that lead to maximal activity and optimal pharmacokinetic properties. Also, the arrangement of the designed ankyrin repeat domains within Protein #134 was chosen to lead to optimal pharmacokinetic properties. When analyzing recombinant binding proteins comprising four designed ankyrin repeat domains including two designed ankyrin repeat domains with binding specificity for serum albumin regarding mouse and cynomolgus monkey pharmacokinetics, the most favorable pharmacokinetic properties were observed for recombinant binding proteins having the two designed ankyrin repeat domains with binding specificity for serum albumin flanking the other two designed ankyrin repeat domains.

As the examples of this example comprise different combinations of designed ankyrin repeat domains with binding specificity for another target than serum albumin, the approach of using at least two designed ankyrin repeat domains with binding specificity for serum albumin for improving the pharmacokinetic properties appears to be generally applicable to proteins comprising several designed ankyrin repeat domains.

Example 7

Simultaneous Binding of Two Human Serum Albumin Molecules by Protein #134

Figure 5:
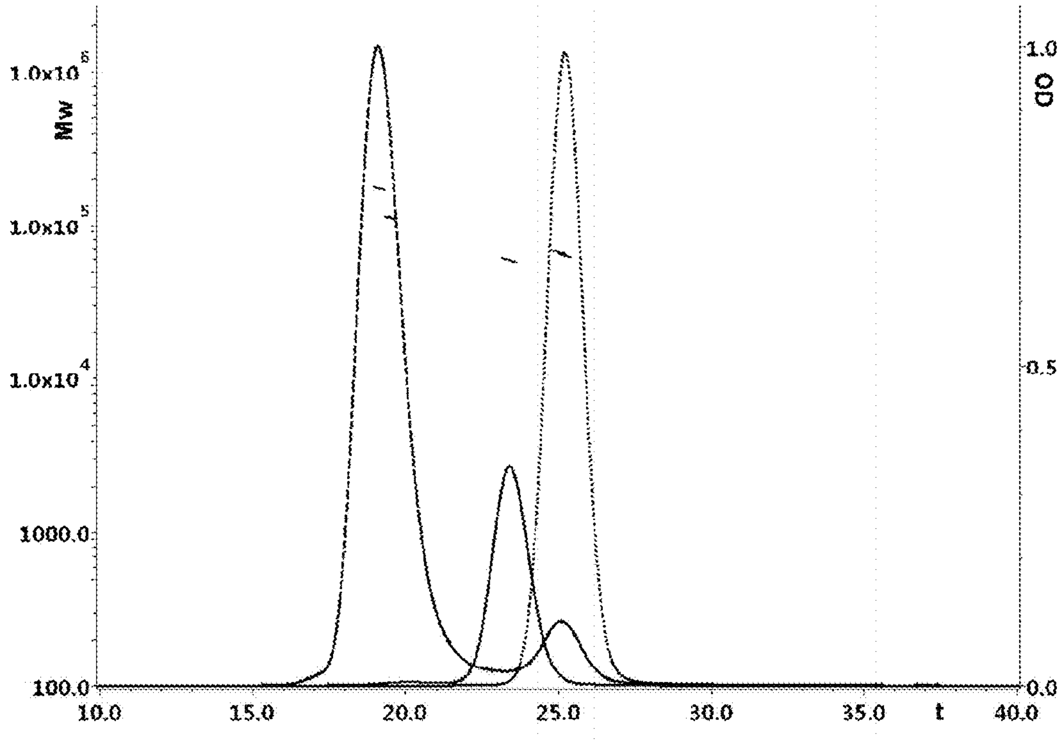
FIG. 5. Size exclusion chromatography coupled to static light scattering of a recombinant binding protein (Protein #134) comprising two designed ankyrin repeat domains with binding specificity for serum albumin. The experiment was performed as described in Example 7 using Protein #134 (a recombinant binding protein consisting of SEQ ID NO: 134; solid line), human serum albumin (dotted line), and a mixture of the two (dashed line). The experiment indicates that Protein #134 comprising two designed ankyrin repeat domains (twice SEQ ID NO: 50) with binding specificity for serum albumin is able to bind two human serum albumin molecules simultaneously.

Protein #134 (A recombinant binding protein consisting of SEQ ID NO: 134, additionally having GS at the N terminus) was prepared as described in Example 4. Protein #134, purified human serum albumin (HSA), as well as Protein #134/HSA mixture (1:2 stoichiometry) were analyzed by size exclusion chromatography coupled to multi-angle static light scattering (SEC-MALS). SEC-MALS was performed using the proteins of Table 6 at 30 μM (Protein #134) or 60 μM (HSA) concentration on a Agilent 1200 system (Life Technologies, USA) connected to a Wyatt (USA) MALS and refractive index detector (flow rate: 0.6 ml/min; injection volume: 100 μl; column: GE Healthcare (USA) Superdex200 10/300 GL). The Protein #134/HSA mixture was pre-incubated for 3 hours at 20° C. prior injection. The chromatograms are shown in FIG. 5 and the molecular masses of the eluates were determined and compared to the theoretical molecular masses, as shown in Table 6. For this experiment, 100 mg HSA (CSL Behring 20% solution) were purified using a Superdex 200_26.60 column on a AEKTA prime system (GE Healthcare; 2.0 ml/min, PBS, isocratic flow, injection volume 10 ml of 1:20 in PBS diluted HSA, collecting 4 ml fractions). The peak fraction of the main peak was used for performance of the SEC-MALS experiment.

Protein #134 at 30 μM was monodisperse with the elution fractions containing protein of the expected molecular weight (FIG. 5). Likewise, purified HSA at 60 μM was monodisperse with the elution fractions containing protein of the expected molecular weight (Table 6). The mixture of 30 μM Protein #134 and 60 μM HSA resulted in two peaks in SEC. One peak contained protein complexes of a molecular weight corresponding to a 1:2 (Protein #134/HSA) complex, indicating that the two designed ankyrin repeat domains with binding specificity for serum albumin are functional simultaneously. Additionally, in the tail of this peak, protein complexes of a molecular weight corresponding to a 1:1 (Protein #134/HSA) complex could be detected. Additionally, free HSA could be detected. As this amount is minor, one can rule out that the main peak is a 2:1 (Protein #134/HSA) complex, which would theoretically be consistent with the observed weight, yet a large fraction corresponding to 75% of free HSA would be expected. No free Protein #134/HSA could be detected. No peaks with a molecular weight corresponding larger than the one of the 1:2 (Protein #134/HSA) complex were detected. SEC-MALS measurements and the variations observed in SEC-MALS measurements are well known to the person skilled in the art.

TABLE 6

Size-exclusion chromatoqraphy coupled to static liqht scattering of Protein #134 and HSA, as well as the complex Protein #134/HSA.

| Peaks | Theoretical stoichiometry & MW | MW measured |
|---|---|---|
| HSA | 69366.6 Da | 63350 Da |
| Protein #134 | 62397.0 Da | 58700 Da |
| Protein #134/HSA tail | 1:1, 131763.6 Da | 132500 Da |
| Protein #134/HSA middle | mixture of 1:1 & 1:2, MW depends on ratio | 173700 Da |
| Protein #134/HSA front | 1:2, 201130.2 Da | 197500 Da |

The simultaneous binding of two human serum albumin molecules by one recombinant binding protein is similarly observed when analyzing Protein #97, and Protein #102, Protein #109, Protein #110 in size exclusion chromatography coupled to static light scattering.

Example 8

Maximizing Target Binding Activity by Choosing Linker Composition and by Choosing the Number of Designed Ankyrin Repeat Domains with Binding Specificity for Serum Albumin Polypeptide linkers that link protein domains are well-known to the person skilled in the art. Gly-Ser-rich linkers are well-known from single-chain Fv antibody fragments, where they are used to link the two Fv polypeptide chains. Various other polypeptide linkers exist, including e.g. antibody hinge regions, or unstructured polypeptides such as sequences comprising mostly the amino acids Ala, Glu, Lys, Pro, Ser, Thr (WO 2007/103515) or Ala, Pro, and Ser (WO 2008/155134). Furthermore, Pro-Thr-rich linkers have been disclosed (WO 2014/191574). The effect of such a linker on the properties of protein domains linked by such linker needs to be assessed for every linker/domain combination. Next to the nature of a polypeptide linker, we surprisingly found that the number of serum albumin-binding domains can influence the functionality of a protein. To maximize target binding activity of the recombinant binding proteins of the present invention, recombinant binding proteins comprising Gly-Ser-rich and Pro-Thr-rich polypeptide linkers were compared as well as recombinant binding proteins comprising one or two designed ankyrin repeat domains with binding specificity for serum albumin. For that purpose, Proteins #69, #71, and, #107, each additionally having SEQ ID NO: 1 at the N terminus and prepared as described in Example 4, were analyzed for binding to VEGF-A and HGF, respectively, by ELISA (for methods see Example 4). The results are shown in Table 7. The comparison of the $EC_{50}$ values of Protein #69 with Protein #71 indicates that the recombinant binding protein with Pro-Thr-rich linkers is more potent with respect to binding of VEGF-A (factor 2) and HGF (factor 1.3), respectively, compared to the recombinant binding proteins with Gly-Ser-rich linkers. The comparison of the $EC_{50}$ values of Protein #69 with Protein #107 indicates that the recombinant binding protein comprising two designed ankyrin repeat domains with binding specificity for serum albumin is more potent with respect to binding of VEGF-A (factor 1.4) and HGF (factor 1.1), respectively, compared to the recombinant binding protein comprising only one designed ankyrin repeat domain with binding specificity for serum albumin. This is surprising in view of previous results (Hopp et al., 2010), where the presence of two albumin binding domains in a construct have a negative impact on the functionality of the molecule. This result indicates that recombinant binding proteins preferentially comprises Pro-Thr-rich linkers and two designed ankyrin repeat domains with binding specificity for serum albumin, rather than Gly-Ser-rich linkers and one designed ankyrin repeat domains with binding specificity for serum albumin.

TABLE 7

ELISA analysis of recombinant binding proteins with different linkers and different numbers of designed ankyrin repeat domains with binding specificity for serum albumin

| Protein #* | Linker | Number of SABD† | $EC_{50}$ [nM] VEGF-A | $EC_{50}$ [nM] HGF |
|---|---|---|---|---|
| 69 | PT | 1 | 0.102 | 0.117 |
| 71 | GS | 1 | 0.205 | 0.179 |
| 107 | PT | 2 | 0.073 | 0.107 |

*Protein #69, #71, and #107 in this table represent designed ankyrin repeat domains consisting of the corresponding amino acid sequence of SEQ ID NOs: 69, 71, and 107, and additionally an N-terminal His-tag (SEQ ID NO: 1).

†Number of designed ankyrin repeat domains with binding specificity for serum albumin

Example 9

Improvement of Protein Stability when Using SEQ ID NO: 50

Proteins #48, #49, and #51 were further characterized for their midpoint of denaturation temperature (i.e. midpoint of the cooperative unfolding upon temperature increase) by mixing the Proteins (25 μl; 100 μM in PBS) with a fluorescent dye (25 μl Sypro orange (Life Technologies) diluted 1/2500 in PBS) and measuring a melting curve with a thermal cycler comprising a fluorescence reader (CFX96 Real-Time PCR Detection System; Biorad; 25 seconds holding time every 0.5° C. followed by fluorescence read), essentially as described by Niesen et al. 2007 (Niesen, F. H., Berglund, H., Vedadi, M., Nature Protocols 2, 2212-2221, 2007). In PBS, Protein #48 exhibited a midpoint of denaturation of 83.5° C., and Protein #49 exhibited a midpoint of denaturation of 84.5° C., while Protein #51 exhibited a midpoint of denaturation of 79.5° C.

In order to identify the designed ankyrin repeat domain with binding specificity for serum albumin having the best storage stability properties, Proteins #49, #50 and #51 (corresponding to SEQ ID NOs: 49, 50 and 51, respectively, additionally having SEQ ID NO: 1 at the N terminus) were prepared as described in Example 4, and samples were concentrated to 10 mg/ml in PBS. Proteins #50 and #51 where then stored for 1 month at −80° C. or at 40° C. in glass vials, followed by analysis on SDS 15% PAGE. While Proteins #50 and #51 showed equivalent stability upon storage at −80° C., Proteins #50 showed significantly reduced amounts of degradation products by >50% reduction compared to Protein #51 on SDS 15% PAGE after 1 month storage at 40° C. Similarly, when stored at 4° C., 25° C., 40° C. and 60° C. for one week at 10 mg/ml in PBS, Protein #50 showed significantly reduced amounts of degradation products compared to Protein #49. In particular, Protein #50 showed >50% reduction of degradation products compared to Protein #49 on SDS 15% PAGE both when stored at 40° C. or 60° C., respectively (FIG. 2).

These findings illustrate that Protein #50 has an improved storage stability compared to Proteins #49 and #51. Similarly, when comparing the storage stability of Proteins #48 to #51 (corresponding to SEQ ID NOs: 48 to 51, additionally having SEQ ID NO: 1 at the N terminus; produced as described in Example 4), by incubating the proteins at 10 mg/ml in PBS in glass vials for 1 month at 40° C., Proteins #48 to #50 exhibit >30% reduction of degradation products compared to Protein #51.

These findings are corroborated by testing the storage stability of Protein #102 and Protein #103 (recombinant binding proteins consisting of the amino acid sequences corresponding to SEQ ID NOs: 102 and 103, both additionally having SEQ ID NO: 1 at the N terminus). Protein #102 and Protein #103 were prepared as described in Example 4, samples were concentrated to 10 mg/ml in PBS and stored for 1 month at −80° C. in or at 40° C. in glass vials, followed by analysis on standard size-exclusion chromatography. While Protein #102 and #103 showed equivalent elution profiles upon storage at −80° C., Protein #102 showed 98.72% monomeric species and Protein #103 showed 100% monomeric species upon storage at 40° C. This indicates that having SEQ ID NO: 50 present in the recombinant binding protein is more favorable regarding storage stability than having SEQ ID NO: 49 present. Similarly, Protein #103 exhibits lower amounts of degradation products than Protein #102 when analyzed by SDS-PAGE after 1 month storage at 40° C. in glass vials in PBS at 10 mg/ml, confirming the higher storage stability of a recombinant binding protein comprising SEQ ID NO: 50 in comparison to the recombinant binding protein comprising SEQ ID NO: 49.

Similar results are obtained when comparing Protein #134 with Protein #143 or Protein #150 (recombinant binding proteins consisting of the amino acid sequences corresponding to SEQ ID NOs: 134, 143 and 150, respectively), prepared as described in Example 4. When stored at 40° C. for one month at 10 mg/ml in PBS in glass vials, Protein #134 shows >50% reduction of degradation products compared to Proteins #143 and #150 when analyzed on SDS 15% PAGE. This indicates that having SEQ ID NO: 50 present in the recombinant binding protein is more favorable regarding storage stability than having either SEQ ID NO: 49 or SEQ ID NO: 51 present.

Example 10

Characterization of Recombinant Binding Proteins Using ELISA

Figure 6A:
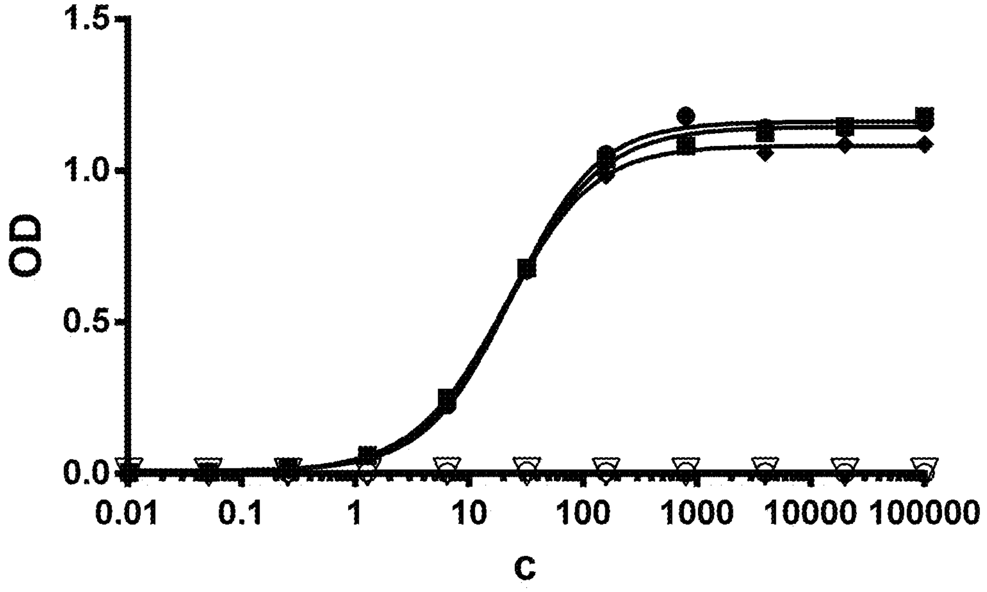
FIG. 6A. Analysis of Protein #134 (a recombinant binding protein consisting of the amino acid sequence of SEQ ID NO: 134) in VEGF-A-binding ELISA, as outlined in Example 10. Protein #134 comprises one designed ankyrin repeat domain with binding specificity for VEGF-A, one designed ankyrin repeat domain with binding specificity for HGF, and two designed ankyrin repeat domains with binding specificity for serum albumin, and, correspondingly, interaction of Protein #134 with these target proteins is expected. The binding signal of various concentrations of Protein #134 to immobilized VEGF-A of human (filled circles), rat (filled squares), and mouse (filled rhombus), as well as human VEGF-C (open inverse triangles), and human PDGF-AB (open circles), and the corresponding fitting inhibition curves are shown. Protein #134 binds VEGF-A of these species with high affinity and is not binding VEGF-C and PDGF-AB.
Figure 6B:
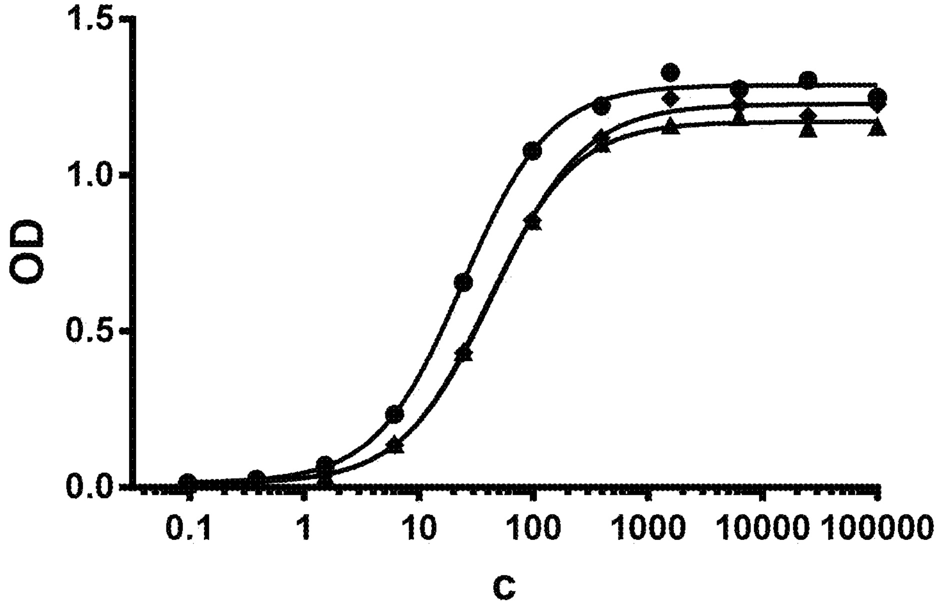
FIG. 6B. Analysis of Protein #134 (a recombinant binding protein consisting of the amino acid sequence of SEQ ID NO: 134) in HGF-binding ELISA, as outlined in Example 10. Protein #134 comprises one designed ankyrin repeat domain with binding specificity for VEGF-A, one designed ankyrin repeat domain with binding specificity for HGF, and two designed ankyrin repeat domains with binding specificity for serum albumin, and, correspondingly, interaction of Protein #134 with these target proteins is expected. The binding signal of various concentrations of Protein #134 to immobilized HGF of human (filled circles), cynomolgus monkey (filled triangles), and mouse (filled rhombus), and the corresponding fitting inhibition curves are shown. Protein #134 binds HGF of these species with high affinity.
Figure 6C:
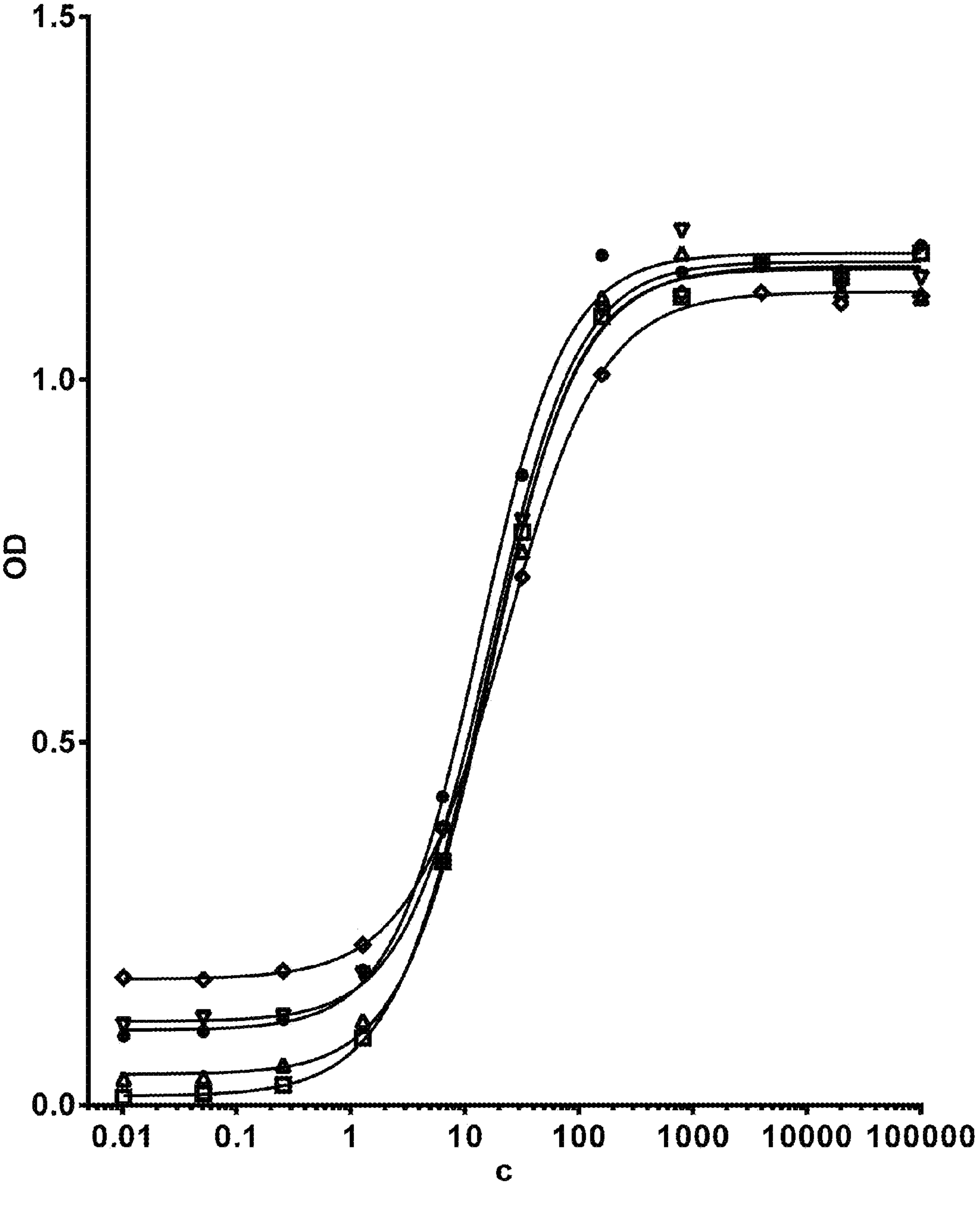
FIG. 6C. Analysis of Protein #134 (a recombinant binding protein consisting of the amino acid sequence of SEQ ID NO: 134) in serum-albumin-binding ELISA, as outlined in Example 10. Protein #134 comprises one designed ankyrin repeat domain with binding specificity for VEGF-A, one designed ankyrin repeat domain with binding specificity for HGF, and two designed ankyrin repeat domains with binding specificity for serum albumin, and, correspondingly, interaction of Protein #134 with these target proteins is expected. The binding signal of various concentrations of Protein #134 to immobilized serum albumin of human (filled circles), cynomolgus monkey (open inverse triangle), rat (open triangle), mouse (open squares), and dog (open rhombus) and the corresponding fitting inhibition curves are shown. Protein #134 binds serum albumin of these species with high affinity. OD, optical density at 450 nm minus OD at 620 nm; c [pM], concentration of recombinant binding protein in pM in logarithmic scale.

Purified recombinant binding protein consisting of the amino acid sequence SEQ ID NO: 134, prepared as described in Example 4, was subjected to ELISA analyses. 100 μl or 50 μl of 20 nM target (VEGF-A, HGF, or serum albumin) in PBS per well were immobilized in a Maxisorp plate (Nunc, Denmark) overnight at 4° C. After washing 5 times with 300 μl PBST (PBS supplemented with 0.1% Tween 20), the wells were blocked with 300 μl PBST-C (PBST supplemented with 0.25% casein) for 2 h at room temperature with shaking at 450 rpm on a Titramax 1000 shaker (Heidolph, Germany). After washing 5 times as described above, 100 μl/well or 50 μl/well Protein #134 (concentrations ranging from 100 nM to 0.01 μM) in PBST-C was applied and incubated for 1 h to 2 h at room temperature with shaking at 450 rpm. After washing 5 times as described above, binding of Protein #134 was detected using 100 μl or 50 μl/well rabbit anti-designed ankyrin repeat domain monoclonal antibody in PBST-C for 1 h at room temperature with shaking at 450 rpm. After washing 5 times as described above, bound anti-designed ankyrin repeat domain antibody was detected using 100 μl or 50 μl/well goat anti-rabbit IgG-HRP conjugate in PBST-C for 1 h at room temperature with shaking at 450 rpm. After washing 5 times as described above, the ELISA was then developed using 100 μl BM soluble blue POD substrate (Roche, Switzerland), diluted 1:4 in water. The reaction was stopped after 5 min using 100 μl 1 M $H_2SO_4$. The OD (OD 450 nm-OD 620 nm) was then recorded. The ELISA results indicate that Protein #134 binds human, cynomolgus monkey, rat and mouse VEGF-A with equivalent potency (Table 8 and FIG. 6A). Cynomolgus monkey VEGF-A is identical to human VEGF-A and was thus not tested separately. No binding of Protein #134 to VEGF-C and PDGF-AB was detected (Table 9 and FIG. 6A). Human, cynomolgus and mouse HGF is bound by Protein #134 with equivalent potency ($EC_{50}$ values in the 20-50 pM range; Table 8 and FIG. 6B). Furthermore, Protein #134 binds serum albumin of human, cynomolgus monkey, rat, dog and mouse with equivalent potency ($EC_{50}$ values in the 10-20 pM range; Table 8 and FIG. 6C). A comparison of Protein #134 (i.e. protein consisting of SEQ ID NO: 134) with Protein #60 or Protein #61 (i.e. proteins consisting of SEQ ID NOs: 60 or 61, additionally having SEQ ID NO: 1 at the N terminus, produced as described in Example 4), revealed that the $EC_{50}$ of Protein #134 observed for the binding of human serum albumin is significantly better than the ones observed for Proteins #60 or #61 (225 pM or 322 pM, respectively).

TABLE 8

Apparent $EC_{50}$ values of Protein #134 for binding VEGF-A HGF and serum albumin of different species

| Species | $EC_{50}$ [pM] VEGF-A (95% C.I.)* | $EC_{50}$ [pM] HGF (95% C.I.)* | $EC_{50}$ [pM] SA (95% C.I.)* |
|---|---|---|---|
| Human | 24 (20-27) | 24 (20-29) | 13 (10-16) |
| Mouse | 21 (19-23) | 45 (38-52) | 15 (13-17) |
| Rat | 22 (18-26) | n.a. | 17 (13-21) |
| Dog | n.a. | n.a. | 23 (20-25) |
| Cynomolgus monkey | 24 (20-27)† | 40 (36-44) | 17 (13-21) |

*C.I. confidence interval,

†100% sequence identity to human VEGF-A, thus the value for human VEGF-A is listed, n.a. not analyzed

TABLE 9

Apparent $EC_{50}$ values of Protein #134 for bindins different human VEGFs and PDGFs

| Target | $EC_{50}$ [pM] (95% C.I.)* |
|---|---|
| Human VEGF-A | 24 (20-27) |
| Human VEGF-C | No binding detected |
| Human PDGF-AB | No binding detected |

*C.I. confidence interval

Example 11

Characterization of Recombinant Binding Proteins Using Competition Assays

Figure 7A:
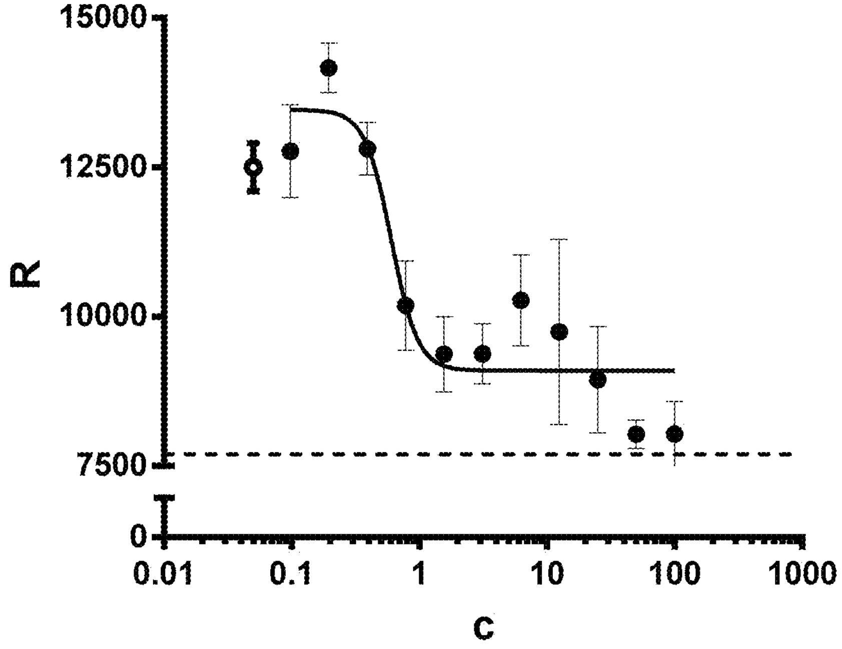
FIG. 7A. VEGF-A/VEGF-R2 and HGF/cMet receptor competition assays. Analysis of Protein #134 (a recombinant binding protein consisting of the amino acid sequence of SEQ ID NO: 134) in various competition assays as described in Example 11.
Figure 7B:
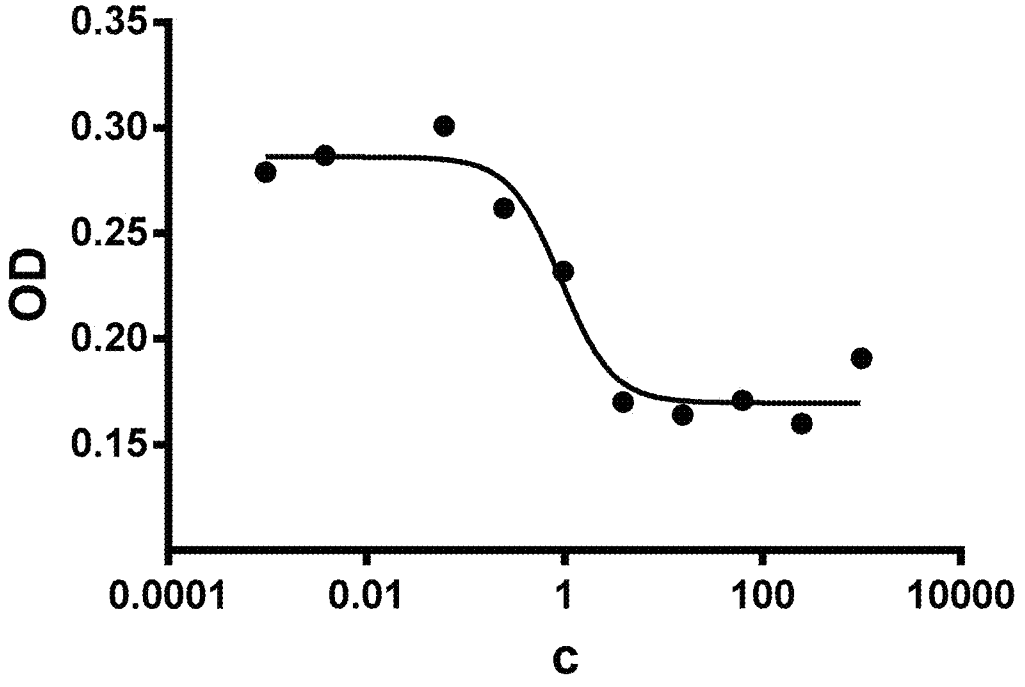
FIG. 7B. VEGF-A/VEGF-R2 and HGF/cMet receptor competition assays. Analysis of Protein #134 (a recombinant binding protein consisting of the amino acid sequence of SEQ ID NO: 134) in various competition assays as described in Example 11.
Figure 7C:
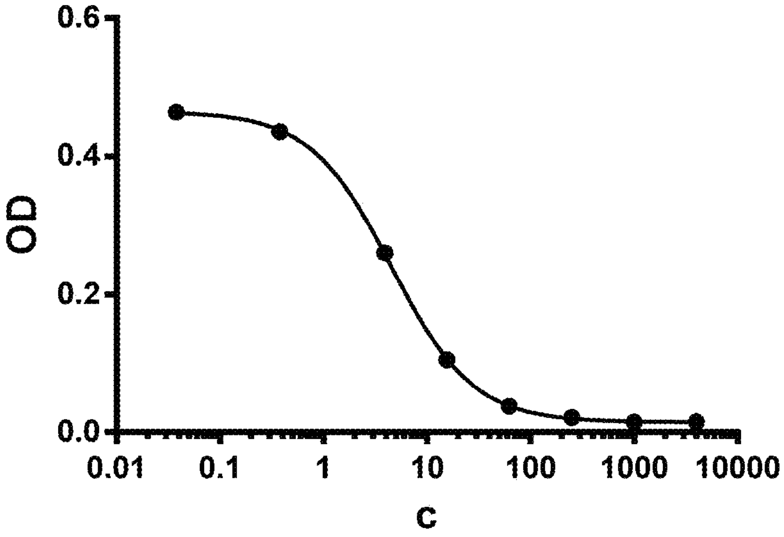
FIG. 7C. VEGF-A/VEGF-R2 and HGF/cMet receptor competition assays. Analysis of Protein #134 (a recombinant binding protein consisting of the amino acid sequence of SEQ ID NO: 134) in various competition assays as described in Example 11.

Purified recombinant binding protein consisting of the amino acid sequence SEQ ID NO: 134, prepared as described in Example 4, was subject to competition ELISA and FRET analyses. Such competition FRET and ELISA assays are well known to the person skilled in the art. Protein #134 was measured in a VEGF-A/VEGFR-2 competition FRET assay. For that purpose, Protein #134 and biotinylated VEGF-A165 (Reliatech, #300-076Bi-L) were prepared as eight-fold concentration stocks in PBS containing 0.2% BSA and 0.01% Tween (PBST-BSA). A competition mixture of 5 μl eight-fold concentration Protein #134 and 5 μl of eight-fold concentration biotinylated VEGF-A165 were pre-incubated for 1 hour at room temperature (competition mixture). In parallel, 5 μl of Streptavidin-Tb (streptavidin-Lumi4-terbium cryptate donor, Cisbio #610SATLB) and 5 μl of PAb anti-hlgG-de (D2-conjugated goat anti-Human IgG, Cisbio #61 HFCDAA) were added to 500 μl of PBST-BSA buffer and incubated for 20 minutes (2× reagent). Ten μl/well of 2× reagent were dispensed in a 384-well HTRF white-plate (Thermo Fisher Scientific Inc.) and 5 μl/well of four-time concentration hVEGF-R2-Fc fusion (Reliatech #SFC-008) were added. Five μl of the preincubated competition mixture were then added to wells. The complete reaction mix was incubated in the dark for 1 hour at room temperature before the fluorescence read out using a fluorescence reader. The final mixture contained 10 nM soluble VEGF-R2-Fc fusion, 10 nM biotinylated VEGF-A, and varying concentrations of Protein #134. The read-out was done for A665 nm and A595 nm wavelength (Excitation 340 nm). The results of the assay are shown in FIG. 7A. In this assay, Protein #134 inhibits the VEGF-A/VEGFR-2 interaction with an $IC_{50}$ value of 0.6 nM. Protein #134 was further measured in a HGF/cMet competition ELISA experiment as described in Example 3. The results of the assay are shown in FIG. 7B. In this assay, Protein #134 inhibits the HGF/cMet interaction with an $IC_{50}$ value of 0.92 nM. Protein #134 was also measured in a VEGF-A competition ELISA experiment as described in Example 3. The results are shown in FIG. 7C. In this assay, Protein #134 inhibits VEGF-binding with an $IC_{50}$ value in the single-digit pM range ($IC_{50}$ 4.5 pM).

Example 12

Figure 8:
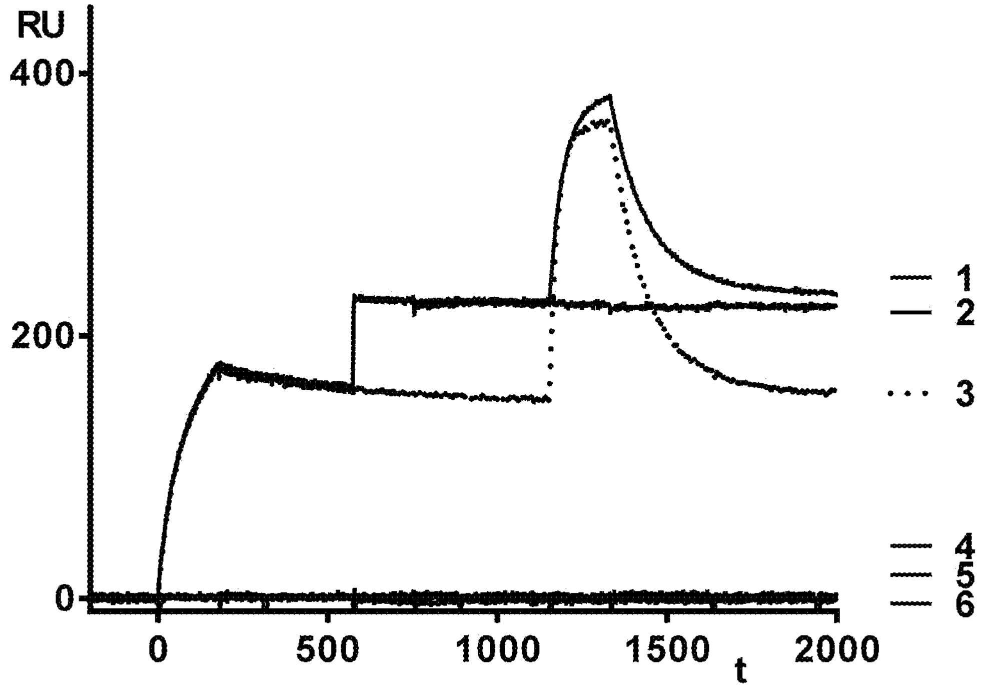
FIG. 8. SPR analysis of recombinant binding proteins. Analysis of the binding of VEGF-A, HGF, and HSA by Protein #134 (a recombinant binding protein consisting of the amino acid sequence of SEQ ID NO: 134) using a Protein instrument as described in Example 12. Human HGF is immobilized on the biosensor chip, and Protein #134, human VEGF-A, or human serum albumin were injected according to the following injection schemes: (1) Protein #134—hVEGF-A—HSA, (2) Protein #134—hVEGF-A—PBST, (3; dotted line) Protein #134—PBST—HSA, (4) PBST—PBST—PBST, (5) PBST—hVEGF-A—PBST, (6) PBST—PBST—HSA. Curves 1 and 2 indicate that Protein #134 can bind human HGF and human VEGF-A simultaneously. Furthermore, since VEGF-A binding reaches saturation in curve 1, curve 1 indicates that Protein #134 can bind human HGF, human VEGF-A and human serum albumin simultaneously. The control injections indicate that no unspecific interaction occurs. RU: resonance units; t: time in seconds.

Characterization of Simultaneous Target Binding of Recombinant Binding Proteins Using Surface Plasmon Resonance SPR was measured in a similar way as described in Example 2, with the following setup. 2700 RU human HGF were immobilized on a sensor chip. Then 100 nM Protein #134 or PBST were injected for 180 seconds followed by a PBST wash of 360 seconds. Following this, 100 nM human VEGF-A or PBST were injected for 180 seconds (leading to saturation) followed by a PBST wash of 360 seconds. Finally, 100 nM human serum albumin or PBST were injected for 180 seconds followed by a PBST wash of 600 seconds. The resulting signals are shown in FIG. 8. The results indicate that Protein #134 can bind HGF, VEGF-A, and serum albumin. Furthermore, the results indicate that Protein #134 can bind HGF and VEGF-A, as well as HGF, VEGF-A, and serum albumin at the same time.

Example 13

Characterization of Recombinant Binding Proteins in Cell Culture

Purified recombinant binding protein consisting of the amino acid sequence SEQ ID NO: 134, prepared as described in Example 4, was further subjected to cellular assays including a HUVEC proliferation assay to assess VEGF-A inhibition, and an A549 cell migration assay as well as a cMet phosphorylation assay, both to assess HGF inhibition, assays well known to the person in the art.

Figure 9A:
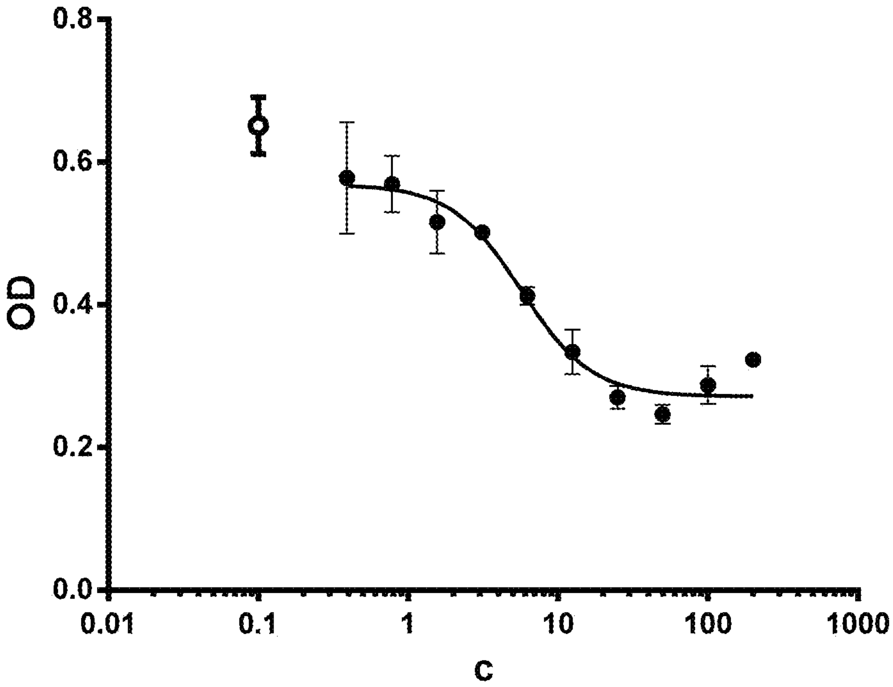
FIG. 9A. Effect of recombinant binding proteins cell proliferation and cell migration. The effect of Protein #134 (a recombinant binding protein consisting of the amino acid sequence of SEQ ID NO: 134) in different cellular assays was assessed as described in Example 13.

Inhibition of VEGF-A-induced HUVEC proliferation was determined by titrating increasing Protein #134 concentrations in the HUVEC proliferation assay. Human VEGF-A was used at a concentration of 8 ng/ml (corresponding to EC80 as determined in a proliferation assay). Protein #134 was titrated from 200 ng/ml to 0.195 ng/ml. Cells were seeded in 50 μl assay medium. Protein dilutions (in assay medium) were made by serial dilution 1:2 fold in a dilution plate; the concentration was four times the final concentration. Protein #134 dilutions were mixed with four-fold VEGF-A concentrations (32 ng/ml; final 8 ng/ml) in a ratio 1:1. 50 μl of the mixtures were added to the cells for 72 h. Cell proliferation was determined either by BrdU incorporation in the replicating DNA or by monitoring metabolic activity using WST-1. The results are shown in FIG. 9A, indicating that Protein #134 exhibits an $IC_{50}$ of 5.7 ng/ml (91.35 μM).

Figure 9B:
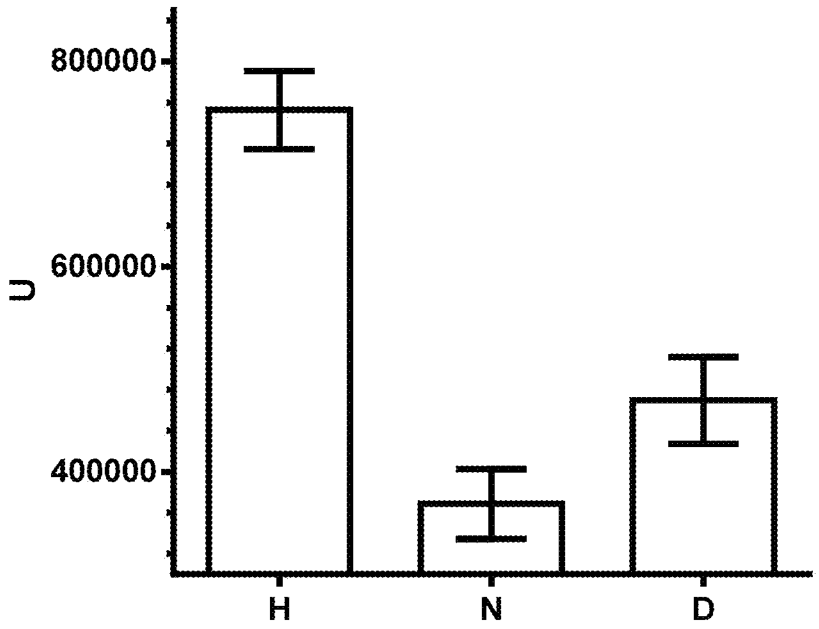
FIG. 9B. Effect of recombinant binding proteins cell proliferation and cell migration. The effect of Protein #134 (a recombinant binding protein consisting of the amino acid sequence of SEQ ID NO: 134) in different cellular assays was assessed as described in Example 13.

Inhibition of the HGF/cMet interaction was determined using Protein #134 in an Oris cell migration assay (Platypus Technologies, USA). The assay was performed according to the manufacturers' protocol. Briefly, cells were seeded with 100,000 A549 cells in serum-free DMEM. Cells adhered after 24 hours and medium was exchanged to assay medium; DMEM with and without 0.5 nM HGF with and without 5 μM Protein. HGF and the neutralizing Protein were preincubated for 1 h at RT before addition to cells. The Oris™ stoppers were removed. The assay was then incubated for 48 hours to permit cell migration. Cells were stained with Calcein (2.5 ng/ml) for 40 minutes and images were taken. The migration zone was measured using an inverse microscope Olympus and its software CellSens Dimension. The migration area was calculated as the covered area by subtracting the uncovered area of the pre-migration well with the uncovered area of respective samples wells. The uncovered area was the cell-free area and was measured using the diameter function in the processing folder of the software. The results are shown in FIG. 9B and indicate that Protein #134 can suppress the HGF-induced cell migration of A549 cells.

Figure 9C:
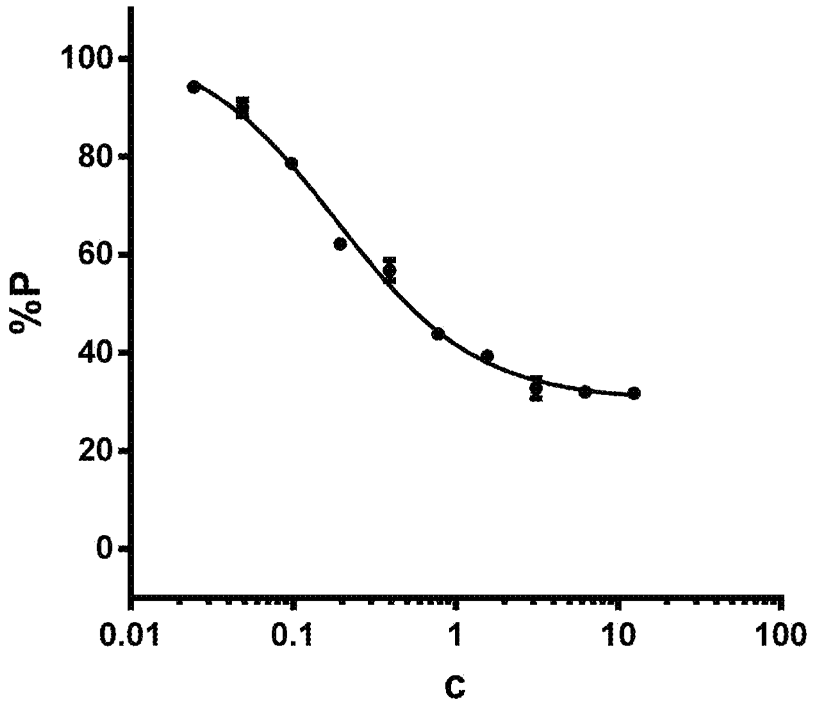
FIG. 9C. Effect of recombinant binding proteins cell proliferation and cell migration. The effect of Protein #134 (a recombinant binding protein consisting of the amino acid sequence of SEQ ID NO: 134) in different cellular assays was assessed as described in Example 13.

Inhibition of cMet phosphorylation by Protein #134 was measured using A549 cells and a DuoSet P-cMet-ELISA (RnD Systems). Cells were seeded in complete medium in 96 well plates ad 200.000 cells per well in complete medium. 24 h later medium was replaced by serum-free medium. Cells were incubated for another 24 h and stimulated by 1 nM human HGF (or PBS for negative control) in the presence and absence of Protein #134. HGF and Protein #134 were preincubated for at least 30 min at room temperature prior to addition to cells. Cells were stimulated for 10 minutes at room temperature. Stimulation was terminated by removing the cell supernatant (by flicking) and addition of cell lysis buffer according to protocol. Cell lysates were kept at −20° C. until the ELISA experiment. The results are shown in FIG. 9C and indicate that Protein #134 can suppress HGF-mediated cMet phosphorylation with an $IC_{50}$ of 184 μM.

Example 14

Effect of Recombinant Binding Proteins on Tumor Growth In Vivo

Figure 10A:
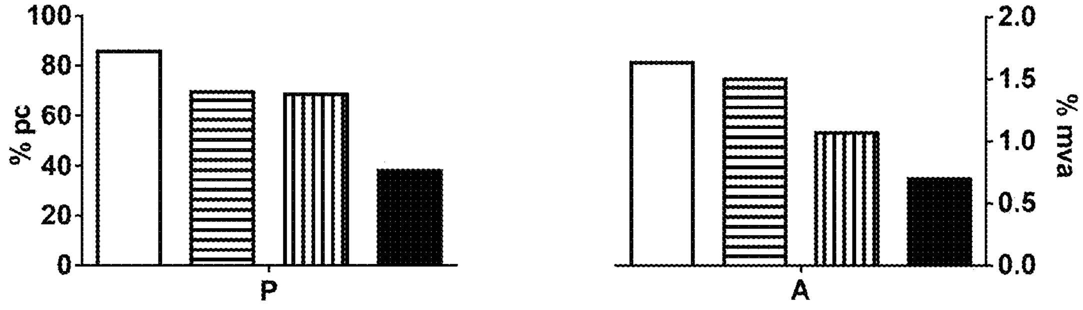
FIG. 10A. Effect of recombinant binding proteins on tumor growth in vivo. The efficacy of Protein #134 (a recombinant binding protein consisting of the amino acid sequence of SEQ ID NO: 134; comprises (i) one designed ankyrin repeat domain with binding specificity for VEGF-A, (ii) one designed ankyrin repeat domain with binding specificity for HGF, and (iii) two designed ankyrin repeat domains with binding specificity for serum albumin; see FIGS. 1A-1I) and of other recombinant binding proteins was assessed in tumor xenograft mouse models as described in Example 14.

A U87MG xenograft mouse model was used to assess the benefit of having a designed ankyrin repeat domain with binding specificity for VEGF-A combined with a designed ankyrin repeat domain with binding specificity for HGF compared to having them separate. Protein #134 consisting of SEQ ID NO: 134 (comprising two designed ankyrin repeat domains with binding specificity for serum albumin each consisting of amino acids of SEQ ID NO: 50, comprising one designed ankyrin repeat domain with binding specificity for VEGF-A consisting of SEQ ID NO: 18, and comprising one designed ankyrin repeat domain with binding specificity for HGF consisting of amino acids of SEQ ID NO: 26), Protein #61 consisting of SEQ ID NO: 61 (comprising a designed ankyrin repeat domain with binding specificity for serum albumin, consisting of amino acids of SEQ ID NO: 50, and comprising a designed ankyrin repeat domain with binding specificity for VEGF-A, consisting of amino acids of SEQ ID NO: 18) and additionally having SEQ ID NO: 1 at the N-terminus, or Protein #60 consisting of SEQ ID NO: 60 (comprising a designed ankyrin repeat domain with binding specificity for serum albumin, consisting of amino acids of SEQ ID NO: 50, and comprising a designed ankyrin repeat domain with binding specificity for HGF, consisting of amino acids of SEQ ID NO: 26) and additionally having SEQ ID NO: 1 at the N-terminus, were prepared as described in Example 4. For the in vivo analysis, $21*0^6$ U87MG cells per mouse were implanted subcutaneously into the right flank of female NMRI nu/nu mice (Harlan) and the mice were grouped in groups with equivalent tumor volumes each. On day 29 and day 32, mice were treated with PBS or 4 mg/kg protein i.v. On day 35, tumors were harvested and cryo-frozen. On every day of treatment the tumor volume of each tumor was measured using the formula: Volume=$(width)^2$×length/2. Body weight measurements indicated no significant difference between the four treatment groups. Tumor cross-sections were then stained using an antibody for Ki67 (ab66155; Abcam, U.K.) for the quantification of proliferation, or using an antibody for CD-31 (BD550274; BD Biosciences, USA) for the quantification of angiogenesis using standard IHC methods. The percentage of proliferative cells and the percentage of mean vascular areas were measured using the software Image J. The results are shown in FIG. 10A. Compared to the PBS, Protein #60 as well as Protein #61 inhibit proliferation, and Protein #60 (slightly) as well as Protein #61 inhibit angiogenesis, as expected. The combination of the two, resulting in Protein #134, however, leads to improved inhibition of both proliferation and angiogenesis. This indicates that the combination of anti-VEGF-A and anti-HGF activity is key for good efficacy.

Protein #134 was further characterized in two patient-derived xenograft mouse models, a gastric cancer model and a renal cancer model. Patient-derived tumor xenograft mouse models are well known to the person skilled in the art. Protein #134 was prepared as described in Example 4.

Figure 10B:
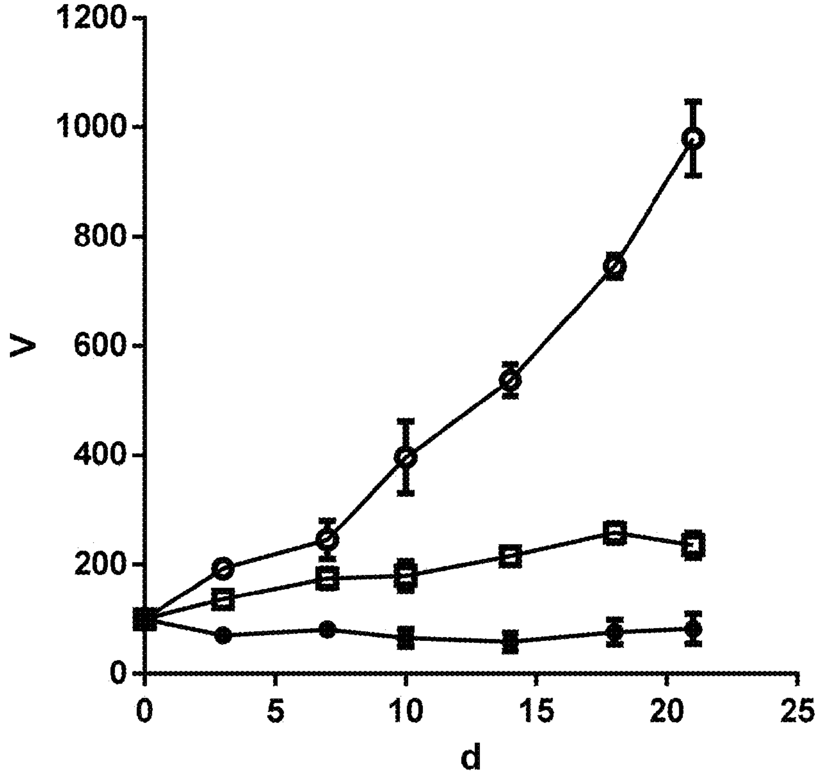
FIG. 10B. Effect of recombinant binding proteins on tumor growth in vivo. The efficacy of Protein #134 (a recombinant binding protein consisting of the amino acid sequence of SEQ ID NO: 134; comprises (i) one designed ankyrin repeat domain with binding specificity for VEGF-A, (ii) one designed ankyrin repeat domain with binding specificity for HGF, and (iii) two designed ankyrin repeat domains with binding specificity for serum albumin; see FIGS. 1A-1I) and of other recombinant binding proteins was assessed in tumor xenograft mouse models as described in Example 14.

For the renal cancer patient-derived xenograft mouse model, renal cell cancer specimens from surgical specimens were implanted s.c. in NMRI nu/nu mice and passaged three to five times until establishment of stable growth patterns. After removal from donor mice, tumors were cut into fragments of 4-5 mm diameter, which were implanted s.c. in NMRI nu/nu mice. Upon obvious onset of solid tumor growth, mice were randomized to groups of three animals each, and test articles were administered as follows to one animal group each: PBS was given i.v. at 10 ml/kg three times weekly for three times; Protein #134 was given i.v. at 4 mg/kg three times weekly for three times; sorafenib was given p.o. at 200 mg/kg daily for 21 days. Tumor volumes were assessed as described above at the day of treatment start as well as on days 3, 7, 10, 14, 18, and 21. The results are shown in FIG. 10B. In this model, Protein #134 is more efficacious than sorafenib, today's standard of care for the treatment of renal cell carcinoma.

Figure 10C:
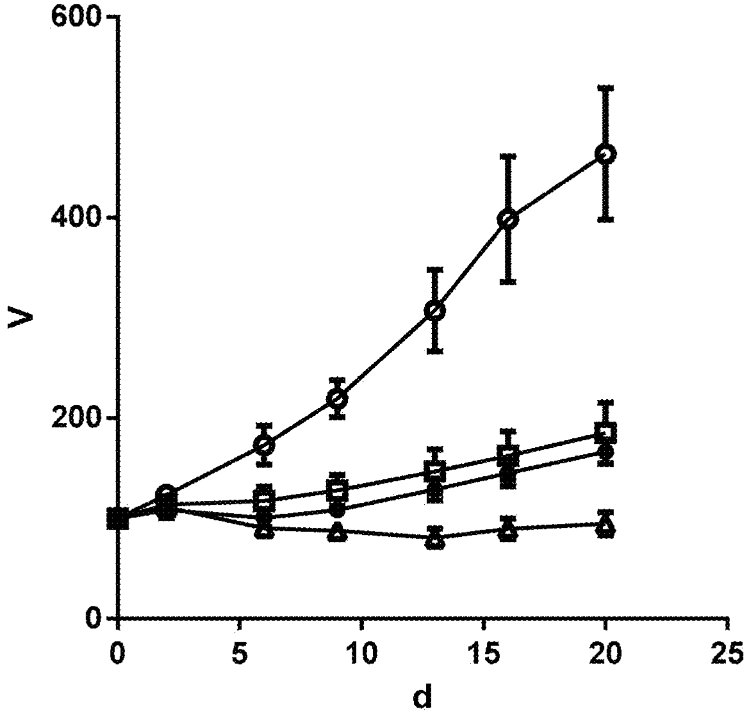
FIG. 10C. Effect of recombinant binding proteins on tumor growth in vivo. The efficacy of Protein #134 (a recombinant binding protein consisting of the amino acid sequence of SEQ ID NO: 134; comprises (i) one designed ankyrin repeat domain with binding specificity for VEGF-A, (ii) one designed ankyrin repeat domain with binding specificity for HGF, and (iii) two designed ankyrin repeat domains with binding specificity for serum albumin; see FIGS. 1A-1I) and of other recombinant binding proteins was assessed in tumor xenograft mouse models as described in Example 14.

For the gastric cancer patient-derived xenograft mouse model, gastric cancer specimens from surgical specimens were implanted to in NMRI nu/nu mice and passaged three to five times until establishment of stable growth patterns. After removal from donor mice, tumors were cut into fragments of 4-5 mm diameter, which were implanted s.c. in NMRI nu/nu mice. Upon obvious onset of solid tumor growth, mice were randomized to groups of eight animals each, and test articles were administered as follows to one animal group each: PBS was given i.v. at 10 ml/kg on days 0, 3, 6, 9, 12, 15, and 18; Protein #134 was given i.v. at 4 ml/kg on days 0, 3, 6, 9, 12, 15, and 18; Paclitaxel was given i.v. at 15 mg/kg on days 0, 7, and 14; Protein #134 plus paclitaxel were given i.v. at 4 mg/kg on days 0, 3, 6, 9, 12, 15, and 18, and i.v. at 15 mg/kg on days 0, 7, and 14. Tumor volumes were assessed as described above at the day of treatment start as well as on days 2, 6, 13, 16, and 20. The results are shown in FIG. 10C. In this model, Protein #134 was at least as efficacious as paclitaxel, and a combination of the two was significantly more efficacious than the individual components.

---

SEQUENCE LISTING (181 sequences)

SEQ ID NO: 1 - protein, 12 aa, Artificial Sequence
  His-tag
MRGSHHHHHHGS

SEQ ID NO: 2 - protein, 5 aa, Artificial Sequence
  GS-linker
GGGGS

SEQ ID NO: 3 - protein, 7 aa, Artificial Sequence
  GS-linker
GGGGSGS

SEQ ID NO: 4 - protein, 12 aa, Artificial Sequence
  Polypeptide linker
GGGGSGGGGSGS

SEQ ID NO: 5 - protein, 17 aa, Artificial Sequence
  GS-linker
GGGGSGGGGSGGGGSGS

SEQ ID NO: 6 - protein, 22 aa, Artificial Sequence
  GS-linker
GGGGSGGGGSGGGGSGGGGSGS

SEQ ID NO: 7 - protein, 10 aa, Artificial Sequence
  PT-linker
GSPTPTPTGS

SEQ ID NO: 8 - protein, 17 aa, Artificial Sequence
  PT-linker
GSPTPTPTTPTPTPTGS

SEQ ID NO: 9 - protein, 24 aa, Artificial Sequence
  PT-linker
GSPTPTPTTPTPTPTTPTPTPTGS

SEQ ID NO: 10 - protein, 157 aa, Artificial Sequence
  Designed ankyrin repeat domain
DLGKKLLEAARAGQDDEVRILMANGADVNATDNDGYTPLHLAASNGHLEIVEVLLKNGADVNASDLTGITPLHLAAATGHLEIVEVLLKHGADVNAYDNDGHTPLHLAAKYGHLEIVEVLLKHGADVNAQDKFGKTAFDISIDNGNEDLAEILQKAA

SEQ ID NO: 11 - protein, 124 aa, Artificial Sequence
  Designed ankyrin repeat domain
DLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKAA

SEQ ID NO: 12 - protein, 157 aa, Artificial Sequence
  Designed ankyrin repeat domain
DLGKKLLEAARAGQDDEVRILMANGADVNAFDWMGWTPLHLAAHEGHLEIVEVLLKNGADVNATDVSGYTPLHLAAADGHLEIVEVLLKHGADVNTKDNTGWTPLHLSADLGHLEIVEVLLKNGADVNAQDKFGKTAFDISIDNGNEDLAEILQKAA

SEQ ID NO: 13 - protein, 157 aa, Artificial Sequence
  Designed ankyrin repeat domain
DLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAA

SEQ ID NO: 14 - protein, 124 aa, Artificial Sequence
  Designed ankyrin repeat domain
DLGKKLLEAARAGQDDEVRILMANGADVNTADSTGWTPLHLAAPWGHPEIVEVLLKNGADVNAHDYQGWTPLHLAATLGHLEIVEVLLKHGADVNAQDKFGKTAFDISIDNGNEDLAEILQKAA

SEQ ID NO: 15 - protein, 124 aa, Artificial Sequence
  Designed ankyrin repeat domain
DLGKKLLEAARAGQDDEVRILMANGADVNTADSTGWTPLHLAVPWGHLEIVEVLLKYGADVNAKDFQGWTPLHLAAAIGHQEIVEVLLKNGADVNAQDKFGKTAFDISIDNGNEDLAEILQKAA

SEQ ID NO: 16 - protein, 124 aa, Artificial Sequence
  Designed ankyrin repeat domain
DLDKKLLEAARAGQDDEVRILMANGADVNAKDSTGYTPLHLAAPWGHLEIVEVLLKAGADVNAKDYQGWTPLHLAAAVGHLEIVEVLLKAGADVNAQDKSGKTPADLAADAGHEDIAEVLQKAA

SEQ ID NO: 17 - protein, 124 aa, Artificial Sequence
  Designed ankyrin repeat domain
DLGKKLLEAARAGQDDEVRILMANGADVNARDSTGWTPLHLAAPWGHPEIVEVLLKNGADVNAADFQGWTPLHLAAAVGHLEIVEVLLKHGADVNAQDKFGKTAFDISIDNGNEDLAEILQKAA

SEQ ID NO: 18 - protein, 124 aa, Artificial Sequence
  Designed ankyrin repeat domain
DLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 19 - protein, 124 aa, Artificial Sequence
  Designed ankyrin repeat domain
DLGKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 20 - protein, 124 aa, Artificial Sequence
  Designed ankyrin repeat domain
DLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAA

SEQ ID NO: 21 - protein, 124 aa, Artificial Sequence
  Designed ankyrin repeat domain
DLDKKLLEAARAGQDDEVRILLKAGADVNAKDSTGWTPLHLAAPWGHPEIVEVLLKAGADVNAKDYQGWTPLHLAAAVGHLEIVEVLLKAGADVNAQDKSGKTPADLAADAGHEDIAEVLQKAA

SEQ ID NO: 22 - protein, 124 aa, Artificial Sequence
  Designed ankyrin repeat domain
DLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAA

SEQ ID NO: 23 - protein, 157 aa, Artificial Sequence
  Designed ankyrin repeat domain
DLGKKLLEAARAGQDDEVRILMANGADVNAKDRFGDTPLHLAADIGHLKIVEVLLKHGADVNAEDWFGNTPLHLAASMGHLEIVEVLLKYGADVNAMDDYGNTPLHLAANTGHLEIVEVLLKHGADVNAQDKFGKTAFDISIDNGNEDLAEILQKAA

SEQ ID NO: 24 - protein, 157 aa, Artificial Sequence
  Designed ankyrin repeat domain
DLGKKLLEAARAGQDDEVRILMANGADVNAKDRFGDTPLHLAADIGHLEIVEVLLKAGADVNAKDWFGNTPLHLAASFGHLEIVEVLLKAGADVNAKDDYGNTPLHLAANTGHLEIVEVLLKAGADVNAQDKFGKTAFDISIDNGNEDLAEILQKAA

SEQ ID NO: 25 - protein, 157 aa, Artificial Sequence
  Designed ankyrin repeat domain
DLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAA

SEQ ID NO: 26 - protein, 157 aa, Artificial Sequence
  Designed ankyrin repeat domain
DLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAA

SEQ ID NO: 27 - protein, 157 aa, Artificial Sequence
  Designed ankyrin repeat domain
DLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAA

SEQ ID NO: 28 - protein, 124 aa, Artificial Sequence
  Designed ankyrin repeat domain
DLGMKLLEAARAGQDDEVRILMANGADVNAHDTWGLTPLHLAAFHGHQEIVEVLLKHGADVNAQDFYGKTPLHLAALRGHLEIVEVLLKYGADVNAQDQFGKTAFDISIDNGNEDLAEILQKAA

SEQ ID NO: 29 - protein, 157 aa, Artificial Sequence
  Designed ankyrin repeat domain
DLGKKLLEAARAGQDDEVRILMANGADVNAKYEDGLTPLHLAAFYGHLEIVEVLLKHGADVNATDAWGHTPLHLAAYYGHLEIVEVLLKYGADVNTHDKEGMTALHLAALTGHLEIVEVLLKNGADVNAQDKFGKTAFDISIDNGNEDLAEILQKAA

SEQ ID NO: 30 - protein, 157 aa, Artificial Sequence
  Designed ankyrin repeat domain
DLGKKLLEAARAGQDDEVRILMANGADVNTHDNFGDTPLHLAASIGHLEIVEVLLKHGADVNAFDSYGDTPLHLAASSGHLEIVEVLLKYGADVNALDYNGNTPLHLAANSGRLEIVEVLLKHGADVNAQDKFGKTAFDISIDNGNEDLAEILQKAA

SEQ ID NO: 31 - protein, 157 aa, Artificial Sequence
  Designed ankyrin repeat domain
DLGKKLLEAARAGQDDEVRILMANGADVNAVDAWGDTPLHLAASIGHLEIVEVLLKNGADVNAADYYGDTPLHLAASAGHLEIVEVLLKYGADVNAQDDNGNTPLHLAANTGRLEIVEVLLKHGADVNAQDKFGKTAFDISIDNGNEDLAEILQKAA

SEQ ID NO: 32 - protein, 157 aa, Artificial Sequence
  Designed ankyrin repeat domain
DLGKKLLEAARAGQDDEVRILMANGADVNAIDTWGNTPLHLAADYGHLEIVEVLLKNGADVNALDWFGDTPLHLAASLGHLEIVEVLLKNGADVNAVDTYGNTPLHLAANTGRLEIVEVLLKYGADVNAQDKFGKTAFDISIDNGNEDLAEILQKAA

SEQ ID NO: 33 - protein, 157 aa, Artificial Sequence
  Designed ankyrin repeat domain
DLGKKLLEAARAGQDDEVRILMANGADVNAQDRWGDTPLHLAASAGHLKIVEVLLKYGADVNADDVFGDTPLHLAASLGHLEIVEVLLKYGADVNADDYAGNTPLHLAANTGHLEIVEVLLKHGADVNAQDKFGKTAFDISIDNGNEDLAEILQKAA

SEQ ID NO: 34 - protein, 157 aa, Artificial Sequence
  Designed ankyrin repeat domain
DLGKKLLEAARAGQDDEVRILMANGADVNAQDRWGDTPLHLAASAGHLKIVEVLLKYGADVNADDVFGDTPLHLAASLGHLEIVEVLLKYGADVNADDYAGNTPLHLAANTGHLEIVEVLLKYGADVNAQDKFGKTAFDISIDNGNEDLAEILQKAA

SEQ ID NO: 35 - protein, 157 aa, Artificial Sequence
  Designed ankyrin repeat domain
DLGKKLLEAARAGQDDEVRILMANGADVNANDFLGLTPLHLAASTGHLEIVEVLLKYGADVNAIDAYGHTPLHLAANNGHLEIVEVLLKYGADVNAIDHFGYTPLHLAAMFGHLEIVEVLLKNGADVNAQDKFGKTAFDISIDNGNEDLAEILQKAA

SEQ ID NO: 36 - protein, 157 aa, Artificial Sequence
  Designed ankyrin repeat domain
DLGKKLLEAARAGQDDEVRILMANGADVNANDSSGLTPLHLAAFYGHLEIVEVLLKYGADVNADDDWGHTPLHLAAHYGHLEIVEVLLKHGADVNAIDTRGLTPLHLAAIAGHLEIVEVLLKYGADVNAQDKFGKTAFDISIDNGNEDLAEILQKAA

SEQ ID NO: 37 - protein, 157 aa, Artificial Sequence
  Designed ankyrin repeat domain
DLGKKLLEAARAGQDDEVRILMANGADVNASDDTGLTPLHLAANRGHLEIVEVLLKHGADVNANDFAGMTPLHLAANVGHLEIVEVLLKYGADVNAHDDYGLTPLHLAANWRHLEIVEVLLKNGADVNAQDKFGKTAFDISIDNGNEDLAEILQKAA

SEQ ID NO: 38 - protein, 157 aa, Artificial Sequence
  Designed ankyrin repeat domain
DLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAA

SEQ ID NO: 39 - protein, 157 aa, Artificial Sequence
  Designed ankyrin repeat domain
DLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAA

SEQ ID NO: 40 - protein, 124 aa, Artificial Sequence
  Designed ankyrin repeat domain
DLGKKLLEAARAGQDDEVRILMASGADVNAADYFSHTPLHLAARDGHLKIVEVLLKYGADVDASDFAGKTPLHLAANDGHLEIVEVLLKHDADVNAQDKFGKTAFDISIDNGNEDLAEILQKAA

SEQ ID NO: 41 - protein, 124 aa, Artificial Sequence
  Designed ankyrin repeat domain
DLGKELLEAARAGQDDEVRILMANGADVNAADYFGHTPLHLAARNGHLKIVEVLLKYGADVNASDFAGKTPLHLAANDGHLEIVEVLLKHGADVNAQDIFGKTAFEISIDNGNEDLAEILQKAA

SEQ ID NO: 42 - protein, 124 aa, Artificial Sequence
  Designed ankyrin repeat domain
DLGKKLLEAARAGQDDEVRILMANGADVNAADYFGHTPLHLAARDGHLKIVEVLLKYGADVNASDFAGKTPLHLAANDGHLEIVEVLLKHGADVNAQDKFGKTAFDISIDNGNEDLAEILQKAA

SEQ ID NO: 43 - protein, 124 aa, Artificial Sequence
  Designed ankyrin repeat domain
DLGKKLLEAARAGQDDEVRILMANGADVNAADYFSHTPLHLAARDGHLKIVEVLLKYGADVNASDFAGKTPLHLAANDGHLEIVEVLLKHGADVNAQDIFGKTAFDISIDNGNEDLAEILQKAA

SEQ ID NO: 44 - protein, 124 aa, Artificial Sequence
  Designed ankyrin repeat domain
DLDKKLLEAARAGQDDEVRILMANGADVNAKDYFSHTPLHLAARNGHLEIVEVLLKAGADVNAKDFAGKTPLHLAANDGHLEIVEVLLKHGADVNAQDIFGKTPADIAADAGHEDIAEVLQKAA

SEQ ID NO: 45 - protein, 124 aa, Artificial Sequence
  Designed ankyrin repeat domain
DLGKKLLEAARAGQDDEVRILMANGADVNAKDYFSHTPLHLAARNGHLEIVEVLLKAGADVNAKDFAGKTPLHLAANDGHLEIVEVLLKHGADVNAQDIFGKTPADIAADAGHEDIAEVLQKAA

SEQ ID NO: 46 - protein, 124 aa, Artificial Sequence
  Designed ankyrin repeat domain
DLGKKLLEAARAGQDDEVRILLAAGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAA

SEQ ID NO: 47 - protein, 124 aa, Artificial Sequence
  Designed ankyrin repeat domain
DLDKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAA

SEQ ID NO: 48 - protein, 124 aa, Artificial Sequence
  Designed ankyrin repeat domain
DLGKKLLEAARAGQDDEVRILLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 49 - protein, 124 aa, Artificial Sequence
  Designed ankyrin repeat domain
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 50 - protein, 124 aa, Artificial Sequence
  Designed ankyrin repeat domain
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 51 - protein, 124 aa, Artificial Sequence
  Designed ankyrin repeat domain
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAA

SEQ ID NO: 52 - protein, 124 aa, Artificial Sequence
  Designed ankyrin repeat domain
DLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 53 - protein, 124 aa, Artificial Sequence
  Designed ankyrin repeat domain
DLGKKLLEAARAGQDDEVRFLMANGADVNAADERGTTPLHLAAVYGHLEIVEVLLKNGADVNAQNETGYTPLHLADSSGHLEIVEVLLKHSADVNAQDKFGKTAFDISIDNGNEDLAEILQKAA

SEQ ID NO: 54 - protein, 124 aa, Artificial Sequence
  Designed ankyrin repeat domain
DLDKKLLEAARAGQDDEVRILMANGADVNAKDERGTTPLHLAAVYGHLEIVEVLLKAGADVNAKNETGYTPLHLADSSGHLEIVEVLLKAGADVNAQDKSGKTPADLAADAGHEDIAEVLQKAA

SEQ ID NO: 55 - protein, 124 aa, Artificial Sequence
  Designed ankyrin repeat domain
DLDKKLLEAARAGQDDEVRILMANGADVNAKDERGTTPLHLAAVYGHLEIVEVLLKAGADVNAKNETGYTPLHLADSSGHLEIVEVLLKHGADVNAQDKSGKTPADLAADAGHEDIAEVLQKAA

SEQ ID NO: 56 - protein, 124 aa, Artificial Sequence
  Designed ankyrin repeat domain
DLDKKLLEAARAGQDDEVRILMANGADVNAKDERGTTPLHLAAVYGHLEIVEVLLKAGADVNAKNETGYTPLHLADSSGHLEIVEVLLKASADVNAQDKSGKTPADLAADAGHEDIAEVLQKAA

SEQ ID NO: 57 - protein, 159 aa, Artificial Sequence
  Designed ankyrin repeat domain with a C-terminal polypeptide linker
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLDITGLKLN

SEQ ID NO: 58 - protein, 302 aa, Artificial Sequence
  Protein comprising two designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGGGGSGGGGSGGGGSGGGGSRSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKLN

SEQ ID NO: 59 - protein, 269 aa, Artificial Sequence
  Protein comprising two designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGGGGSGGGGSGGGGSGGGGSRSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKLN

SEQ ID NO: 60 - protein, 305 aa, Artificial Sequence
  Protein comprising two designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAA

SEQ ID NO: 61 - protein, 272 aa, Artificial Sequence
  Protein comprising two designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 62 - protein, 273 aa, Artificial Sequence
  Protein comprising two designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 63 - protein, 269 aa, Artificial Sequence
  Protein comprising two designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGGGGSGGGGSGGGGSGGGGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 64 - protein, 273 aa, Artificial Sequence
  Protein comprising two designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKLN

SEQ ID NO: 65 - protein, 273 aa, Artificial Sequence
  Protein comprising two designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKLN

SEQ ID NO: 66 - protein, 272 aa, Artificial Sequence
  Protein comprising two designed ankyrin repeat domains
DLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAA

SEQ ID NO: 67 - protein, 272 aa, Artificial Sequence
  Protein comprising two designed ankyrin repeat domains
DLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 68 - protein, 488 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGSPTPTPTTPTPTPTTPTPTPTGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLN

SEQ ID NO: 69 - protein, 488 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLGSPTPTPTTPTPTPTTPTPTPTGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLN

SEQ ID NO: 70 - protein, 480 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGGGGSGGGGSGGGGSGGGGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGGGGSGGGGSGGGGSGGGGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLN

SEQ ID NO: 71 - protein, 480 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGGGGSGGGGSGGGGSGGGGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLGGGGSGGGGSGGGGSGGGGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLN

SEQ ID NO: 72 - protein, 455 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGSPTPTPTTPTPTPTTPTPTPTGSRSDLDKKLLEAARAGQDDEVRILMANGADVNAKDSTGYTPLHLAAPWGHLEIVEVLLKAGADVNAKDYQGWTPLHLAAAVGHLEIVEVLLKAGADVNAQDKSGKTPADLAADAGHEDIAEVLQKLN

SEQ ID NO: 73 - protein, 422 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 74 - protein, 422 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKLN

SEQ ID NO: 75 - protein, 422 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 76 - protein, 422 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKLN

SEQ ID NO: 77 - protein, 420 aa, Artificial Sequence
  Protein comprising three designed ankyrin repeat domains
DLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAA

SEQ ID NO: 78 - protein, 420 aa, Artificial Sequence
  Protein comprising three designed ankyrin repeat domains
DLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 79 - protein, 420 aa, Artificial Sequence
  Protein comprising three designed ankyrin repeat domains
DLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 80 - protein, 420 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 81 - protein, 420 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAA

SEQ ID NO: 82 - protein, 422 aa, Artificial Sequence
  Protein comprising three designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKLGSPTPTPTTPTPTPTTPTPTPTGSRSDLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKLN

SEQ ID NO: 83 - protein, 486 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAA

SEQ ID NO: 84 - protein, 486 aa, Artificial Sequence
  Protein comprising three designed ankyrin repeat domains
DLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 85 - protein, 453 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 86 - protein, 449 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 87 - protein, 453 aa, Artificial Sequence
  Protein comprising three designed ankyrin repeat domains
DLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 88 - protein, 480 aa, Artificial Sequence; identical to SEQ ID NO: 71
  Protein comprising three designed ankyrin repeat domains

SEQ ID NO: 89 - protein, 453 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAA

SEQ ID NO: 90 - protein, 453 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAA

SEQ ID NO: 91 - protein, 449 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDYQGWTPLHLAAAVGHLEIVEVLLKAGADVNAQDKSGKTPADLAADAGHEDIAEVLQKAAGGGGSGGGGSGGGGSGGGGSGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAA

SEQ ID NO: 92 - protein, 453 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAA

SEQ ID NO: 93 - protein, 453 aa, Artificial Sequence
  Protein comprising three designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDYQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAA

SEQ ID NO: 94 - protein, 453 aa, Artificial Sequence
  Protein comprising three designed ankyrin repeat domains
DLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 95 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 96 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 97 - protein, 637 aa, Artificial Sequence
  Protein comprising four designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGSPTPTPTTPTPTPTTPTPTPTGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 98 - protein, 637 aa, Artificial Sequence
  Protein comprising four designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLGSPTPTPTTPTPTPTTPTPTPTGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 99 - protein, 625 aa, Artificial Sequence
  Protein comprising four designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGGGGSGGGGSGGGGSGGGGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGGGGSGGGGSGGGGSGGGGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLGGGGSGGGGSGGGGSGGGGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 100 - protein, 625 aa, Artificial Sequence
  Protein comprising four designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGGGGSGGGGSGGGGSGGGGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLGGGGSGGGGSGGGGSGGGGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGGGGSGGGGSGGGGSGGGGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 101 - protein, 595 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 102 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 103 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 104 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 105 - protein, 595 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDYQGWTPLHLAAAVGHLEIVEVLLKAGADVNAQDKSGKTPADLAADAGHEDIAEVLQKAAGGGGSGGGGSGGGGSGGGGSGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 106 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 107 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDYQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 108 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAA

SEQ ID NO: 109 - protein, 571 aa, Artificial Sequence
  Protein comprising four designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKLGSPTPTPTTPTPTPTTPTPTPTGSRSDLGKKLLEAARAGQDDEVRILMANGADVNAKDKDGYTPLHLAAREGHLEIVEVLLKAGADVNAKDKDGYTPLHLAAREGHLEIVEVLLKAGADVNAQDKFGKTAFDISIDNGNEDLAEILQKLN

SEQ ID NO: 110 - protein, 634 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 111 - protein, 634 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAA

SEQ ID NO: 112 - protein, 634 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAA

SEQ ID NO: 113 - protein, 634 aa, Artificial Sequence
  Protein comprising four designed ankyrin repeat domains
DLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 114 - protein, 634 aa, Artificial Sequence
  Protein comprising four designed ankyrin repeat domains
DLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 115 - protein, 634 aa, Artificial Sequence
  Protein comprising four designed ankyrin repeat domains
DLGKKLLEAARAGQDDEVRELLKAGADVNAKDKSGNTPLHLAARFGHLEIVEFLLKAGADVNAKDETGKTPLHLAAIWGHLEIVEVLLKAGADVNAKDLYGRTPLHLAAKLRHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRELLKAGADVNALDQIGWTPLHLAANYGHLEIVEVLLKAGADVNAKDLWGQTPLHLAAWKGHLEIVEVLLKAGADVNAKDTDGLTPLHLAAIRGHLEIVEVLLKAGADVNAQDKSGKTPADLAADAGHEDIAEVLQKAA

SEQ ID NO: 116 - protein, 595 aa, Artificial Sequence; identical to SEQ ID NO: 101
  Protein comprising four designed ankyrin repeat domains

SEQ ID NO: 117 - protein, 601 aa, Artificial Sequence
  Protein comprising four designed ankyrin repeat domains
DLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 118 - protein, 601 aa, Artificial Sequence
  Protein comprising four designed ankyrin repeat domains
DLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 119 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 120 - protein, 601 aa, Artificial Sequence
  Protein comprising four designed ankyrin repeat domains
DLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 121 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 122 - protein, 601 aa, Artificial Sequence
  Protein comprising four designed ankyrin repeat domains
DLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 123 - protein, 601 aa, Artificial Sequence
  Protein comprising four designed ankyrin repeat domains
DLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 124 - protein, 601 aa, Artificial Sequence
  Protein comprising four designed ankyrin repeat domains
DLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAA

SEQ ID NO: 125 - protein, 601 aa, Artificial Sequence
  Protein comprising four designed ankyrin repeat domains
DLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAA

SEQ ID NO: 126 - protein, 601 aa, Artificial Sequence
  Protein comprising four designed ankyrin repeat domains
DLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAA

SEQ ID NO: 127 - protein, 601 aa, Artificial Sequence
  Protein comprising four designed ankyrin repeat domains
DLDKKLLEAARAGQDDEVRILMANGADVNAKDSTGWTPLHLAAPWGHLEIVEVLLKAGADVNAKDFQGWTPLHLAAAVGHLEIVEVLLKAGADVNAQDKFGKTAFDISIDNGNEDLAEILQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 128 - protein, 637 aa, Artificial Sequence
  Protein comprising four designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLGSPTPTPTTPTPTPTTPTPTPTGSRSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKLGSPTPTPTTPTPTPTTPTPTPTGSRSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKLN

SEQ ID NO: 129 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 130 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAA

SEQ ID NO: 131 - protein, 601 aa, Artificial Sequence
  Protein comprising four designed ankyrin repeat domains
DLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 132 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 133 - protein, 601 aa, Artificial Sequence
  Protein comprising four designed ankyrin repeat domains
DLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 134 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 135 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 136 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 137 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 138 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 139 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 140 - protein, 636 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 141 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 142 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRFGDTPLHLAADIGHLKIVEVLLKHGADVNAEDWFGNTPLHLAASMGHLEIVEVLLKYGADVNAMDDYGNTPLHLAANTGHLEIVEVLLKHGADVNAQDKFGKTAFDISIDNGNEDLAEILQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 143 - protein, 603 aa, Artificial Sequence; identical to SEQ ID NO: 134
  Protein comprising four designed ankyrin repeat domains

SEQ ID NO: 144 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 145 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 146 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAA

SEQ ID NO: 147 - protein, 603 aa, Artificial Sequence
  Protein comprising four designed ankyrin repeat domains
GSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 148 - protein, 603 aa, Artificial Sequence
  Protein comprising four designed ankyrin repeat domains
GSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 149 - protein, 597 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 150 - protein, 603 aa, Artificial Sequence
  Protein comprising four designed ankyrin repeat domains
GSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAA

SEQ ID NO: 151 - protein, 603 aa, Artificial Sequence
  Protein comprising four designed ankyrin repeat domains
GSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 152 - protein, 597 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGGGGSGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 153 - protein, 582 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 154 - protein, 561 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 155 - protein, 582 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 156 - protein, 567 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 157 - protein, 601 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 158 - protein, 599 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 159 - protein, 597 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 160 - protein, 582 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 161 - protein, 567 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 162 - protein, 601 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 163 - protein, 599 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGGGGSGGGGSGGGGSGGGGSGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 164 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANEGHLEIVEVLLKAGADVNAQDIFGKTPADIAADAGHEDIAEVLQKAA

SEQ ID NO: 165 - protein, 636 aa, Artificial Sequence
  Protein comprising four designed ankyrin repeat domains
GSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGSPTPTPTTPTPTPTTPTPTPTGSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 166 - protein, 636 aa, Artificial Sequence
  Protein comprising four designed ankyrin repeat domains
GSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAAGSPTPTPTTPTPTPTTPTPTPTGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 167 - protein, 630 aa, Artificial Sequence
  Protein comprising four designed ankyrin repeat domains
GSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAAGGGGSGGGGSGGGGSGGGGSGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGGGGSGGGGSGGGGSGGGGSGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGGGGSGGGGSGGGGSGGGGSGSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 168 - protein, 630 aa, Artificial Sequence
  Protein comprising four designed ankyrin repeat domains
GSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKAAGGGGSGGGGSGGGGSGGGGSGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGGGGSGGGGSGGGGSGGGGSGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGGGGSGGGGSGGGGSGGGGSGSDLGKKLLEAARAGQDDEVRILMANGADVNAKDYFSHTPLHLAARNGHLKIVEVLLKAGADVNAKDFAGKTPLHLAANDGHLEIVEVLLKHGADVNAQDIFGKTPADIAADAGHEDIAEVLQKLN

SEQ ID NO: 169 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 170 - protein, 597 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGGGGSGGGGSGGGGSGGGGSGSDLDKKLLEAARAGQDDEVRILLKAGADVNAKDSTGWTPLHLAAPWGHPEIVEVLLKAGADVNAKDYQGWTPLHLAAAVGHLEIVEVLLKAGADVNAQDKSGKTPADLAADAGHEDIAEVLQKAAGGGGSGGGGSGGGGSGGGGSGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGGGGSGGGGSGGGGSGGGGSGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 171 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 172 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDYQGWTPLHLAAAVGHLEIVEVLLKAGADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 173 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAA

SEQ ID NO: 174 - protein, 603 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILMANGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAVGHLEIVEVLLKAGADVNAQDKSGKTPADLAADAGHEDIAEVLQKAA

SEQ ID NO: 175 - protein, 636 aa, Artificial Sequence
  Protein comprising four designed ankyrin repeat domains
GSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAAGSPTPTPTTPTPTPTTPTPTPTGSDLGKKLLEAARAGQDDEVRILLKAGADVNAKDRYGDTPLHLAADAGHLKIVEVLLKAGADVNAEDYFGNTPLHLAASAGHLEIVEVLLKAGADVNAKDDAGNTPLHLAANTGHLKIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGSPTPTPTTPTPTPTTPTPTPTGSDLGKKLLEAARAGQDDEVRELLKAGADVNAKDYFSHTPLHLAARNGHLKIVEVLLKAGADVNAKDFAGKTPLHLAANDGHLEIVEVLLKAGADVNAQDIFGKTPADIAADAGHEDIAEVLQKAA

SEQ ID NO: 176 - protein, 570 aa, Artificial Sequence
  Protein comprising four designed ankyrin repeat domains
GSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGMKLLEAARAGQDDEVRILMANGADVNAHDTWGLTPLHLAAFHGHQEIVEVLLKHGADVNAQDFYGKTPLHLAALRGHLEIVEVLLKYGADVNAQDQFGKTAFDISIDNGNEDLAEILQKAAGSPTPTPTTPTPTPTTPTPTPTGSDLDKKLLEAARAGQDDEVRILLKAGADVNAKDSTGWTPLHLAAPWGHPEIVEVLLKAGADVNAKDFQGWTPLHLAAAAGHLEIVEVLLKAGADVNAQDKSGKTPADLAADAGHEDIAEVLQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 177 - protein, 636 aa, Artificial Sequence
  Protein comprising four designed ankyrin repeat domains
GSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGKKLLEAARAGQDDEVRILLKAGADVNAKDRYGDTPLHLAADIGHLEIVEVLLKAGADVNAEDYFGNTPLHLAASYGHLEIVEVLLKAGADVNAKDDYGNTPLHLAANTGHLEIVEVLLKAGADVNAQDKSGKTPADLAADAGHEDIAEVLQKAAGSPTPTPTTPTPTPTTPTPTPTGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 178 - protein, 603 aa, Artificial Sequence
  Protein comprising four designed ankyrin repeat domains
GSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLGMKLLEAARAGQDDEVRILMANGADVNAHDTWGLTPLHLAAFHGHQEIVEVLLKHGADVNAQDFYGKTPLHLAALRGHLEIVEVLLKYGADVNAQDQFGKTAFDISIDNGNEDLAEILQKAAGSPTPTPTTPTPTPTTPTPTPTGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 179 - protein, 603 aa, Artificial Sequence
  Protein comprising four designed ankyrin repeat domains
GSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAAGSPTPTPTTPTPTPTTPTPTPTGSDLDKKLLEAARAGQDDEVRILLKAGADVNAKDYLGWTPLHLAAHEGHLEIVEVLLKAGADVNAKDVSGYTPLHLAAADGHLEIVEVLLKAGADVNAKDNTGWTPLHLSADLGHLEIVEVLLKAGADVNAQDKFGKTAFDISIDNGNEDLAEILQKAAGSPTPTPTTPTPTPTTPTPTPTGSDLGMKLLEAARAGQDDEVRILMANGADVNAHDTWGLTPLHLAAFHGHQEIVEVLLKHGADVNAQDFYGKTPLHLAALRGHLEIVEVLLKYGADVNAQDQFGKTAFDISIDNGNEDLAEILQKAAGSPTPTPTTPTPTPTTPTPTPTGSDLDKKLLEAARAGQDDEVRILMANGADVNAKDERGTTPLHLAAVYGHLEIVEVLLKAGADVNAKNETGYTPLHLADSSGHLEIVEVLLKHSADVNAQDKSGKTPADLAADAGHEDIAEVLQKAA

SEQ ID NO: 180 - protein, 33 aa, Artificial Sequence
  Ankyrin repeat module of designed ankyrin repeat domains with binding specificity for serum albumin.
KDYFSHTPLHLAARNGHLKIVEVLLKAGADVNA

SEQ ID NO: 181 - protein, 33 aa, Artificial Sequence
  Ankyrin repeat module of designed ankyrin repeat domains with binding specificity for serum albumin.
  VARIANT 1: Xaa represents an amino acid residue selected from the group consisting of D, K and A
  VARIANT 1..33: Optionally up to 5, 4, 3, 2, 1, 0 amino acids in other than the positions denoted with Xaa can be exchanged by any amino acid
  VARIANT 5: Xaa represents an amino acid residue selected from the group consisting of D, G and S
  VARIANT 15: Xaa represents an amino acid residue selected from the group consisting of E, N, D, H, S, A, Q, T and G
  VARIANT 16: Xaa represents an amino acid residue selected from the group consisting of G and D
  VARIANT 19: Xaa represents an amino acid residue selected from the group consisting of E, K and G
  VARIANT 27: Xaa represents an amino acid residue selected from the group consisting of H, Y, A and N
XDYFXHTPLHLAARXXHLXIVEVLLKXGADVNA

---

The invention claimed is:

1. A recombinant binding protein comprising the amino acid sequence of SEQ ID NO: 134.

2. The binding protein of claim 1, wherein the binding protein has binding specificity for HGF, VEGF-A, and serum albumin.

3. The binding protein of claim 1, wherein the binding protein is capable of binding to HGF, VEGF-A, and serum albumin simultaneously.

4. A pharmaceutical composition comprising the binding protein of claim 1 and a pharmaceutically acceptable carrier and/or diluent.

5. A method of treating a medical condition, the method comprising the step of administering to a patient in need thereof a therapeutically effective amount of a recombinant binding protein comprising the amino acid sequence of SEQ ID NO: 134, wherein the medical condition is a neoplastic disease, pathological angiogenesis, and/or an inflammatory disorder.

6. The method of claim 5, wherein the medical condition is renal cancer.

7. The method of claim 5, wherein the medical condition is gastric cancer.

8. The method of claim 5, wherein the medical condition is multiple myeloma.

9. A recombinant binding protein comprising at least one designed ankyrin repeat domain, wherein the binding protein has binding specificity for VEGF-A, and wherein the binding protein comprises the amino acid sequence of SEQ ID NO: 134.

10. The binding protein of claim 9, wherein the VEGF-A is human VEGF-A.

11. The binding protein of claim 9, wherein the binding protein inhibits binding interaction between VEGF-A and VEGFR-2.

12. The binding protein of claim 9, wherein the binding protein inhibits VEGF-A-induced proliferation of HUVEC cells.

13. A pharmaceutical composition comprising the binding protein of claim 9 and a pharmaceutically acceptable carrier and/or diluent.

14. A method of treating a medical condition, the method comprising the step of administering to a patient in need thereof a therapeutically effective amount of a recombinant binding protein comprising at least one designed ankyrin repeat domain, wherein the binding protein has binding specificity for VEGF-A, wherein the binding protein comprises the amino acid sequence of SEQ ID NO: 134, and wherein the medical condition is a neoplastic disease, pathological angiogenesis, and/or an inflammatory disorder.

15. A recombinant binding protein comprising at least one designed ankyrin repeat domain, wherein the binding protein has binding specificity for HGF, and wherein the binding protein comprises the amino acid sequence of SEQ ID NO: 134.

16. The binding protein of claim 15, wherein the HGF is human HGF.

17. The binding protein of claim 15, wherein the binding protein inhibits binding interaction between HGF and cMet.

18. The binding protein of claim 15, wherein the binding protein inhibits HGF-induced cell migration of A549 cells.

19. The binding protein of claim 15, wherein the binding protein inhibits HGF-induced phosphorylation of cMet in A549 cells.

20. A pharmaceutical composition comprising the binding protein of claim 15 and a pharmaceutically acceptable carrier and/or diluent.

21. A method of treating a medical condition, the method comprising the step of administering to a patient in need thereof a therapeutically effective amount of a recombinant binding protein comprising at least one designed ankyrin repeat domain, wherein the binding protein has binding specificity for HGF, wherein the binding protein comprises the amino acid sequence of SEQ ID NO: 134, and wherein the medical condition is a neoplastic disease, pathological angiogenesis, and/or an inflammatory disorder.

22. A binding protein consisting of the amino acid sequence of SEQ ID NO: 134.

23. A pharmaceutical composition comprising the binding protein of claim 22 and a pharmaceutically acceptable carrier and/or diluent.

24. A method of treating a medical condition, the method comprising the step of administering to a patient in need thereof a therapeutically effective amount of a recombinant binding protein consisting of the amino acid sequence of SEQ ID NO: 134, wherein the medical condition is a neoplastic disease, pathological angiogenesis, and/or an inflammatory disorder.

25. The method of claim 24, wherein the medical condition is renal cancer.

26. The method of claim 24, wherein the medical condition is gastric cancer.

27. The method of claim 24, wherein the medical condition is multiple myeloma.

* * * * *